United States Patent 8,969,254 (OLIGONUCLEOTIDE ARRAY FOR TISSUE TYPING) - sequence listing, part 18

SEQ ID NO: 411670 - DNA, 22 bp, Artificial Sequence
  Description of Artificial Sequence: Synthetic oligonucleotide
tgggggagtaccggccggtgac

SEQ ID NO: 411671 - DNA, 21 bp, Artificial Sequence
  Description of Artificial Sequence: Synthetic oligonucleotide
gggggagtaccggccggtgac

SEQ ID NO: 411672 - DNA, 21 bp, Artificial Sequence
  Description of Artificial Sequence: Synthetic oligonucleotide
ggggagtaccggccggtgacg

SEQ ID NO: 411673 - DNA, 22 bp, Artificial Sequence
  Description of Artificial Sequence: Synthetic oligonucleotide
gggagtaccggccggtgacgga

SEQ ID NO: 411674 - DNA, 22 bp, Artificial Sequence
  Description of Artificial Sequence: Synthetic oligonucleotide
ggagtaccggccggtgacggag

SEQ ID NO: 411675 - DNA, 23 bp, Artificial Sequence
  Description of Artificial Sequence: Synthetic oligonucleotide
gagtaccggccggtgacggagct

SEQ ID NO: 411676 - DNA, 23 bp, Artificial Sequence
  Description of Artificial Sequence: Synthetic oligonucleotide
agtaccggccggtgacggagctg

SEQ ID NO: 411677 - DNA, 22 bp, Artificial Sequence
  Description of Artificial Sequence: Synthetic oligonucleotide
gtaccggccggtgacggagctg

SEQ ID NO: 411678 - DNA, 22 bp, Artificial Sequence
  Description of Artificial Sequence: Synthetic oligonucleotide
taccggccggtgacggagctgg

SEQ ID NO: 411679 - DNA, 21 bp, Artificial Sequence
  Description of Artificial Sequence: Synthetic oligonucleotide
accggccggtgacggagctgg

SEQ ID NO: 411680 - DNA, 20 bp, Artificial Sequence
  Description of Artificial Sequence: Synthetic oligonucleotide
ccggccggtgacggagctgg

SEQ ID NO: 411681 - DNA, 20 bp, Artificial Sequence
  Description of Artificial Sequence: Synthetic oligonucleotide
cggccggtgacggagctggg

SEQ ID NO: 411682 - DNA, 20 bp, Artificial Sequence
  Description of Artificial Sequence: Synthetic oligonucleotide
ggccggtgacggagctgggg

SEQ ID NO: 411683 - DNA, 20 bp, Artificial Sequence
  Description of Artificial Sequence: Synthetic oligonucleotide
gccggtgacggagctggggc

SEQ ID NO: 411684 - DNA, 20 bp, Artificial Sequence
  Description of Artificial Sequence: Synthetic oligonucleotide
ccggtgacggagctggggcg

SEQ ID NO: 411685 - DNA, 29 bp, Artificial Sequence
  Description of Artificial Sequence: Synthetic oligonucleotide
atttcttcaatgggacggagcgggtgcag

SEQ ID NO: 411686 - DNA, 28 bp, Artificial Sequence
  Description of Artificial Sequence: Synthetic oligonucleotide
tttcttcaatgggacggagcgggtgcag

SEQ ID NO: 411687 - DNA, 27 bp, Artificial Sequence
  Description of Artificial Sequence: Synthetic oligonucleotide
ttcttcaatgggacggagcgggtgcag

SEQ ID NO: 411688 - DNA, 27 bp, Artificial Sequence
  Description of Artificial Sequence: Synthetic oligonucleotide
tcttcaatgggacggagcgggtgcagt

SEQ ID NO: 411689 - DNA, 27 bp, Artificial Sequence
  Description of Artificial Sequence: Synthetic oligonucleotide
cttcaatgggacggagcgggtgcagta

SEQ ID NO: 411690 - DNA, 27 bp, Artificial Sequence
  Description of Artificial Sequence: Synthetic oligonucleotide
ttcaatgggacggagcgggtgcagtac

SEQ ID NO: 411691 - DNA, 26 bp, Artificial Sequence
  Description of Artificial Sequence: Synthetic oligonucleotide
tcaatgggacggagcgggtgcagtac

SEQ ID NO: 411692 - DNA, 25 bp, Artificial Sequence
  Description of Artificial Sequence: Synthetic oligonucleotide
caatgggacggagcgggtgcagtac

SEQ ID NO: 411693 - DNA, 26 bp, Artificial Sequence
  Description of Artificial Sequence: Synthetic oligonucleotide
aatgggacggagcgggtgcagtacct

SEQ ID NO: 411694 - DNA, 25 bp, Artificial Sequence
  Description of Artificial Sequence: Synthetic oligonucleotide
atgggacggagcgggtgcagtacct

SEQ ID NO: 411695 - DNA, 24 bp, Artificial Sequence
  Description of Artificial Sequence: Synthetic oligonucleotide
tgggacggagcgggtgcagtacct

SEQ ID NO: 411696 - DNA, 23 bp, Artificial Sequence
  Description of Artificial Sequence: Synthetic oligonucleotide
gggacggagcgggtgcagtacct

SEQ ID NO: 411697 - DNA, 23 bp, Artificial Sequence
  Description of Artificial Sequence: Synthetic oligonucleotide
ggacggagcgggtgcagtacctg

SEQ ID NO: 411698 - DNA, 24 bp, Artificial Sequence
  Description of Artificial Sequence: Synthetic oligonucleotide
gacggagcgggtgcagtacctgga

SEQ ID NO: 411699 - DNA, 25 bp, Artificial Sequence
  Description of Artificial Sequence: Synthetic oligonucleotide
acggagcgggtgcagtacctggaca

SEQ ID NO: 411700 - DNA, 24 bp, Artificial Sequence
  Description of Artificial Sequence: Synthetic oligonucleotide
cggagcgggtgcagtacctggaca

SEQ ID NO: 411701 - DNA, 27 bp, Artificial Sequence
  Description of Artificial Sequence: Synthetic oligonucleotide
ggagcgggtgcagtacctggacagata

SEQ ID NO: 411702 - DNA, 27 bp, Artificial Sequence
  Description of Artificial Sequence: Synthetic oligonucleotide
gagcgggtgcagtacctggacagatac

SEQ ID NO: 411703 - DNA, 29 bp, Artificial Sequence
  Description of Artificial Sequence: Synthetic oligonucleotide
agcgggtgcagtacctggacagatacttc

SEQ ID NO: 411704 - DNA, 28 bp, Artificial Sequence
  Description of Artificial Sequence: Synthetic oligonucleotide
gcgggtgcagtacctggacagatacttc

SEQ ID NO: 411705 - DNA, 28 bp, Artificial Sequence
  Description of Artificial Sequence: Synthetic oligonucleotide
cgggtgcagtacctggacagatacttcc

SEQ ID NO: 411706 - DNA, 32 bp, Artificial Sequence; identical to SEQ ID NO: 66301
  Description of Artificial Sequence: Synthetic oligonucleotide

SEQ ID NO: 411707 - DNA, 32 bp, Artificial Sequence; identical to SEQ ID NO: 66302
  Description of Artificial Sequence: Synthetic oligonucleotide

SEQ ID NO: 411708 - DNA, 33 bp, Artificial Sequence; identical to SEQ ID NO: 66303
  Description of Artificial Sequence: Synthetic oligonucleotide

SEQ ID NO: 411709 - DNA, 33 bp, Artificial Sequence; identical to SEQ ID NO: 66304
  Description of Artificial Sequence: Synthetic oligonucleotide

SEQ ID NO: 411710 - DNA, 32 bp, Artificial Sequence; identical to SEQ ID NO: 66305
  Description of Artificial Sequence: Synthetic oligonucleotide

SEQ ID NO: 411711 - DNA, 33 bp, Artificial Sequence; identical to SEQ ID NO: 66306
  Description of Artificial Sequence: Synthetic oligonucleotide

SEQ ID NO: 411712 - DNA, 33 bp, Artificial Sequence; identical to SEQ ID NO: 66307
  Description of Artificial Sequence: Synthetic oligonucleotide

SEQ ID NO: 411713 - DNA, 26 bp, Artificial Sequence
  Description of Artificial Sequence: Synthetic oligonucleotide
ggggccgggtggacaactactgcata

SEQ ID NO: 411714 - DNA, 27 bp, Artificial Sequence
  Description of Artificial Sequence: Synthetic oligonucleotide
gggccgggtggacaactactgcataca

SEQ ID NO: 411715 - DNA, 27 bp, Artificial Sequence
  Description of Artificial Sequence: Synthetic oligonucleotide
ggccgggtggacaactactgcatacac

SEQ ID NO: 411716 - DNA, 29 bp, Artificial Sequence
  Description of Artificial Sequence: Synthetic oligonucleotide
gccgggtggacaactactgcatacacaac

SEQ ID NO: 411717 - DNA, 31 bp, Artificial Sequence; identical to SEQ ID NO: 66312
  Description of Artificial Sequence: Synthetic oligonucleotide

SEQ ID NO: 411718 - DNA, 31 bp, Artificial Sequence; identical to SEQ ID NO: 66313
  Description of Artificial Sequence: Synthetic oligonucleotide

SEQ ID NO: 411719 - DNA, 31 bp, Artificial Sequence; identical to SEQ ID NO: 66314
  Description of Artificial Sequence: Synthetic oligonucleotide

SEQ ID NO: 411720 - DNA, 31 bp, Artificial Sequence; identical to SEQ ID NO: 66315
  Description of Artificial Sequence: Synthetic oligonucleotide

SEQ ID NO: 411721 - DNA, 31 bp, Artificial Sequence; identical to SEQ ID NO: 66316
  Description of Artificial Sequence: Synthetic oligonucleotide

SEQ ID NO: 411722 - DNA, 33 bp, Artificial Sequence; identical to SEQ ID NO: 66317
  Description of Artificial Sequence: Synthetic oligonucleotide

SEQ ID NO: 411723 - DNA, 32 bp, Artificial Sequence; identical to SEQ ID NO: 66318
  Description of Artificial Sequence: Synthetic oligonucleotide

SEQ ID NO: 411724 - DNA, 33 bp, Artificial Sequence; identical to SEQ ID NO: 66319
  Description of Artificial Sequence: Synthetic oligonucleotide

SEQ ID NO: 411725 - DNA, 33 bp, Artificial Sequence; identical to SEQ ID NO: 66320
  Description of Artificial Sequence: Synthetic oligonucleotide

SEQ ID NO: 411726 - DNA, 32 bp, Artificial Sequence; identical to SEQ ID NO: 66321
  Description of Artificial Sequence: Synthetic oligonucleotide

SEQ ID NO: 411727 - DNA, 33 bp, Artificial Sequence; identical to SEQ ID NO: 66322
  Description of Artificial Sequence: Synthetic oligonucleotide

SEQ ID NO: 411728 - DNA, 32 bp, Artificial Sequence; identical to SEQ ID NO: 66323
  Description of Artificial Sequence: Synthetic oligonucleotide

SEQ ID NO: 411729 - DNA, 31 bp, Artificial Sequence; identical to SEQ ID NO: 66324
  Description of Artificial Sequence: Synthetic oligonucleotide

SEQ ID NO: 411730 - DNA, 32 bp, Artificial Sequence; identical to SEQ ID NO: 66325
  Description of Artificial Sequence: Synthetic oligonucleotide

SEQ ID NO: 411731 - DNA, 31 bp, Artificial Sequence; identical to SEQ ID NO: 66326
  Description of Artificial Sequence: Synthetic oligonucleotide

SEQ ID NO: 411732 - DNA, 30 bp, Artificial Sequence; identical to SEQ ID NO: 66327
  Description of Artificial Sequence: Synthetic oligonucleotide

SEQ ID NO: 411733 - DNA, 30 bp, Artificial Sequence; identical to SEQ ID NO: 66328
  Description of Artificial Sequence: Synthetic oligonucleotide

SEQ ID NO: 411734 - DNA, 29 bp, Artificial Sequence
  Description of Artificial Sequence: Synthetic oligonucleotide
gcatacacaactacggggttgtggagagc

SEQ ID NO: 411735 - DNA, 31 bp, Artificial Sequence; identical to SEQ ID NO: 66330
  Description of Artificial Sequence: Synthetic oligonucleotide

SEQ ID NO: 411736 - DNA, 32 bp, Artificial Sequence; identical to SEQ ID NO: 66331
  Description of Artificial Sequence: Synthetic oligonucleotide

SEQ ID NO: 411737 - DNA, 31 bp, Artificial Sequence; identical to SEQ ID NO: 66332
  Description of Artificial Sequence: Synthetic oligonucleotide

SEQ ID NO: 411738 - DNA, 27 bp, Artificial Sequence
  Description of Artificial Sequence: Synthetic oligonucleotide
ccgggtggacaactactgcagacacag

SEQ ID NO: 411739 - DNA, 27 bp, Artificial Sequence
  Description of Artificial Sequence: Synthetic oligonucleotide
cgggtggacaactactgcagacacagc

SEQ ID NO: 411740 - DNA, 29 bp, Artificial Sequence
  Description of Artificial Sequence: Synthetic oligonucleotide
gggtggacaactactgcagacacagctac

SEQ ID NO: 411741 - DNA, 29 bp, Artificial Sequence
  Description of Artificial Sequence: Synthetic oligonucleotide
ggtggacaactactgcagacacagctacg

SEQ ID NO: 411742 - DNA, 29 bp, Artificial Sequence
  Description of Artificial Sequence: Synthetic oligonucleotide
gtggacaactactgcagacacagctacgg

SEQ ID NO: 411743 - DNA, 29 bp, Artificial Sequence
  Description of Artificial Sequence: Synthetic oligonucleotide
tggacaactactgcagacacagctacggg

SEQ ID NO: 411744 - DNA, 28 bp, Artificial Sequence
  Description of Artificial Sequence: Synthetic oligonucleotide
ggacaactactgcagacacagctacggg

SEQ ID NO: 411745 - DNA, 28 bp, Artificial Sequence
  Description of Artificial Sequence: Synthetic oligonucleotide
gacaactactgcagacacagctacgggg

SEQ ID NO: 411746 - DNA, 30 bp, Artificial Sequence
  Description of Artificial Sequence: Synthetic oligonucleotide
acaactactgcagacacagctacggggttg

SEQ ID NO: 411747 - DNA, 29 bp, Artificial Sequence
  Description of Artificial Sequence: Synthetic oligonucleotide
caactactgcagacacagctacggggttg

SEQ ID NO: 411748 - DNA, 30 bp, Artificial Sequence
  Description of Artificial Sequence: Synthetic oligonucleotide
aactactgcagacacagctacggggttgtg

SEQ ID NO: 411749 - DNA, 29 bp, Artificial Sequence
  Description of Artificial Sequence: Synthetic oligonucleotide
actactgcagacacagctacggggttgtg

SEQ ID NO: 411750 - DNA, 28 bp, Artificial Sequence
  Description of Artificial Sequence: Synthetic oligonucleotide
ctactgcagacacagctacggggttgtg

SEQ ID NO: 411751 - DNA, 28 bp, Artificial Sequence
  Description of Artificial Sequence: Synthetic oligonucleotide
tactgcagacacagctacggggttgtgg

SEQ ID NO: 411752 - DNA, 27 bp, Artificial Sequence
  Description of Artificial Sequence: Synthetic oligonucleotide
actgcagacacagctacggggttgtgg

SEQ ID NO: 411753 - DNA, 27 bp, Artificial Sequence
  Description of Artificial Sequence: Synthetic oligonucleotide
ctgcagacacagctacggggttgtgga

SEQ ID NO: 411754 - DNA, 27 bp, Artificial Sequence
  Description of Artificial Sequence: Synthetic oligonucleotide
tgcagacacagctacggggttgtggag

SEQ ID NO: 411755 - DNA, 27 bp, Artificial Sequence
  Description of Artificial Sequence: Synthetic oligonucleotide
gcagacacagctacggggttgtggaga

SEQ ID NO: 411756 - DNA, 27 bp, Artificial Sequence
  Description of Artificial Sequence: Synthetic oligonucleotide
cagacacagctacggggttgtggagag

SEQ ID NO: 411757 - DNA, 27 bp, Artificial Sequence
  Description of Artificial Sequence: Synthetic oligonucleotide
agacacagctacggggttgtggagagc

SEQ ID NO: 411758 - DNA, 27 bp, Artificial Sequence
  Description of Artificial Sequence: Synthetic oligonucleotide
gacacagctacggggttgtggagagct

SEQ ID NO: 411759 - DNA, 28 bp, Artificial Sequence
  Description of Artificial Sequence: Synthetic oligonucleotide
acacagctacggggttgtggagagcttc

SEQ ID NO: 411760 - DNA, 27 bp, Artificial Sequence
  Description of Artificial Sequence: Synthetic oligonucleotide
cacagctacggggttgtggagagcttc

SEQ ID NO: 411761 - DNA, 28 bp, Artificial Sequence
  Description of Artificial Sequence: Synthetic oligonucleotide
acagctacggggttgtggagagcttcac

SEQ ID NO: 411762 - DNA, 27 bp, Artificial Sequence
  Description of Artificial Sequence: Synthetic oligonucleotide
cagctacggggttgtggagagcttcac

SEQ ID NO: 411763 - DNA, 28 bp, Artificial Sequence
  Description of Artificial Sequence: Synthetic oligonucleotide
agctacggggttgtggagagcttcacag

SEQ ID NO: 411764 - DNA, 27 bp, Artificial Sequence
  Description of Artificial Sequence: Synthetic oligonucleotide
gctacggggttgtggagagcttcacag

SEQ ID NO: 411765 - DNA, 36 bp, Artificial Sequence
  Description of Artificial Sequence: Synthetic oligonucleotide
acgtttcttggagtactctacgtctgagtgtcattc

SEQ ID NO: 411766 - DNA, 35 bp, Artificial Sequence
  Description of Artificial Sequence: Synthetic oligonucleotide
cgtttcttggagtactctacgtctgagtgtcattc

SEQ ID NO: 411767 - DNA, 35 bp, Artificial Sequence
  Description of Artificial Sequence: Synthetic oligonucleotide
gtttcttggagtactctacgtctgagtgtcattcc

SEQ ID NO: 411768 - DNA, 37 bp, Artificial Sequence
  Description of Artificial Sequence: Synthetic oligonucleotide
tttcttggagtactctacgtctgagtgtcattccttc

SEQ ID NO: 411769 - DNA, 36 bp, Artificial Sequence
  Description of Artificial Sequence: Synthetic oligonucleotide
ttcttggagtactctacgtctgagtgtcattccttc

SEQ ID NO: 411770 - DNA, 35 bp, Artificial Sequence
  Description of Artificial Sequence: Synthetic oligonucleotide
tcttggagtactctacgtctgagtgtcattccttc

SEQ ID NO: 411771 - DNA, 34 bp, Artificial Sequence
  Description of Artificial Sequence: Synthetic oligonucleotide
cttggagtactctacgtctgagtgtcattccttc

SEQ ID NO: 411772 - DNA, 37 bp, Artificial Sequence
  Description of Artificial Sequence: Synthetic oligonucleotide
ttggagtactctacgtctgagtgtcattccttcaatg

SEQ ID NO: 411773 - DNA, 36 bp, Artificial Sequence
  Description of Artificial Sequence: Synthetic oligonucleotide
tggagtactctacgtctgagtgtcattccttcaatg

SEQ ID NO: 411774 - DNA, 35 bp, Artificial Sequence
  Description of Artificial Sequence: Synthetic oligonucleotide
ggagtactctacgtctgagtgtcattccttcaatg

SEQ ID NO: 411775 - DNA, 35 bp, Artificial Sequence
  Description of Artificial Sequence: Synthetic oligonucleotide
gagtactctacgtctgagtgtcattccttcaatgg

SEQ ID NO: 411776 - DNA, 35 bp, Artificial Sequence
  Description of Artificial Sequence: Synthetic oligonucleotide
agtactctacgtctgagtgtcattccttcaatggg

SEQ ID NO: 411777 - DNA, 34 bp, Artificial Sequence
  Description of Artificial Sequence: Synthetic oligonucleotide
gtactctacgtctgagtgtcattccttcaatggg

SEQ ID NO: 411778 - DNA, 35 bp, Artificial Sequence
  Description of Artificial Sequence: Synthetic oligonucleotide
tactctacgtctgagtgtcattccttcaatgggac

SEQ ID NO: 411779 - DNA, 34 bp, Artificial Sequence
  Description of Artificial Sequence: Synthetic oligonucleotide
actctacgtctgagtgtcattccttcaatgggac

SEQ ID NO: 411780 - DNA, 33 bp, Artificial Sequence
  Description of Artificial Sequence: Synthetic oligonucleotide
ctctacgtctgagtgtcattccttcaatgggac

SEQ ID NO: 411781 - DNA, 33 bp, Artificial Sequence
  Description of Artificial Sequence: Synthetic oligonucleotide
tctacgtctgagtgtcattccttcaatgggacg

SEQ ID NO: 411782 - DNA, 32 bp, Artificial Sequence
  Description of Artificial Sequence: Synthetic oligonucleotide
ctacgtctgagtgtcattccttcaatgggacg

SEQ ID NO: 411783 - DNA, 32 bp, Artificial Sequence
  Description of Artificial Sequence: Synthetic oligonucleotide
tacgtctgagtgtcattccttcaatgggacgg

SEQ ID NO: 411784 - DNA, 31 bp, Artificial Sequence
  Description of Artificial Sequence: Synthetic oligonucleotide
acgtctgagtgtcattccttcaatgggacgg

SEQ ID NO: 411785 - DNA, 30 bp, Artificial Sequence
  Description of Artificial Sequence: Synthetic oligonucleotide
cgtctgagtgtcattccttcaatgggacgg

SEQ ID NO: 411786 - DNA, 31 bp, Artificial Sequence
  Description of Artificial Sequence: Synthetic oligonucleotide
gtctgagtgtcattccttcaatgggacggag

SEQ ID NO: 411787 - DNA, 31 bp, Artificial Sequence
  Description of Artificial Sequence: Synthetic oligonucleotide
tctgagtgtcattccttcaatgggacggagc

SEQ ID NO: 411788 - DNA, 30 bp, Artificial Sequence
  Description of Artificial Sequence: Synthetic oligonucleotide
ctgagtgtcattccttcaatgggacggagc

SEQ ID NO: 411789 - DNA, 30 bp, Artificial Sequence
  Description of Artificial Sequence: Synthetic oligonucleotide
tgagtgtcattccttcaatgggacggagcg

SEQ ID NO: 411790 - DNA, 29 bp, Artificial Sequence
  Description of Artificial Sequence: Synthetic oligonucleotide
gagtgtcattccttcaatgggacggagcg

SEQ ID NO: 411791 - DNA, 29 bp, Artificial Sequence
  Description of Artificial Sequence: Synthetic oligonucleotide
agtgtcattccttcaatgggacggagcgg

SEQ ID NO: 411792 - DNA, 28 bp, Artificial Sequence
  Description of Artificial Sequence: Synthetic oligonucleotide
gtgtcattccttcaatgggacggagcgg

SEQ ID NO: 411793 - DNA, 28 bp, Artificial Sequence
  Description of Artificial Sequence: Synthetic oligonucleotide
tgtcattccttcaatgggacggagcggg

SEQ ID NO: 411794 - DNA, 27 bp, Artificial Sequence
  Description of Artificial Sequence: Synthetic oligonucleotide
gtcattccttcaatgggacggagcggg

SEQ ID NO: 411795 - DNA, 28 bp, Artificial Sequence
  Description of Artificial Sequence: Synthetic oligonucleotide
tcattccttcaatgggacggagcgggtg

SEQ ID NO: 411796 - DNA, 27 bp, Artificial Sequence
  Description of Artificial Sequence: Synthetic oligonucleotide
cattccttcaatgggacggagcgggtg

SEQ ID NO: 411797 - DNA, 27 bp, Artificial Sequence
  Description of Artificial Sequence: Synthetic oligonucleotide
attccttcaatgggacggagcgggtgc

SEQ ID NO: 411798 - DNA, 26 bp, Artificial Sequence
  Description of Artificial Sequence: Synthetic oligonucleotide
ttccttcaatgggacggagcgggtgc

SEQ ID NO: 411799 - DNA, 25 bp, Artificial Sequence
  Description of Artificial Sequence: Synthetic oligonucleotide
tccttcaatgggacggagcgggtgc

SEQ ID NO: 411800 - DNA, 24 bp, Artificial Sequence
  Description of Artificial Sequence: Synthetic oligonucleotide
ccttcaatgggacggagcgggtgc

SEQ ID NO: 411801 - DNA, 31 bp, Artificial Sequence
  Description of Artificial Sequence: Synthetic oligonucleotide
acaactactgcagacacaactacggggttgc

SEQ ID NO: 411802 - DNA, 30 bp, Artificial Sequence
  Description of Artificial Sequence: Synthetic oligonucleotide
caactactgcagacacaactacggggttgc

SEQ ID NO: 411803 - DNA, 30 bp, Artificial Sequence
  Description of Artificial Sequence: Synthetic oligonucleotide
aactactgcagacacaactacggggttgcg

SEQ ID NO: 411804 - DNA, 29 bp, Artificial Sequence
  Description of Artificial Sequence: Synthetic oligonucleotide
actactgcagacacaactacggggttgcg

SEQ ID NO: 411805 - DNA, 28 bp, Artificial Sequence
  Description of Artificial Sequence: Synthetic oligonucleotide
ctactgcagacacaactacggggttgcg

SEQ ID NO: 411806 - DNA, 28 bp, Artificial Sequence
  Description of Artificial Sequence: Synthetic oligonucleotide
tactgcagacacaactacggggttgcgg

SEQ ID NO: 411807 - DNA, 27 bp, Artificial Sequence
  Description of Artificial Sequence: Synthetic oligonucleotide
actgcagacacaactacggggttgcgg

SEQ ID NO: 411808 - DNA, 27 bp, Artificial Sequence
  Description of Artificial Sequence: Synthetic oligonucleotide
ctgcagacacaactacggggttgcgga

SEQ ID NO: 411809 - DNA, 27 bp, Artificial Sequence
  Description of Artificial Sequence: Synthetic oligonucleotide
tgcagacacaactacggggttgcggag

SEQ ID NO: 411810 - DNA, 27 bp, Artificial Sequence
  Description of Artificial Sequence: Synthetic oligonucleotide
gcagacacaactacggggttgcggaga

SEQ ID NO: 411811 - DNA, 27 bp, Artificial Sequence
  Description of Artificial Sequence: Synthetic oligonucleotide
cagacacaactacggggttgcggagag

SEQ ID NO: 411812 - DNA, 27 bp, Artificial Sequence
  Description of Artificial Sequence: Synthetic oligonucleotide
agacacaactacggggttgcggagagc

SEQ ID NO: 411813 - DNA, 27 bp, Artificial Sequence
  Description of Artificial Sequence: Synthetic oligonucleotide
gacacaactacggggttgcggagagct

SEQ ID NO: 411814 - DNA, 28 bp, Artificial Sequence
  Description of Artificial Sequence: Synthetic oligonucleotide
acacaactacggggttgcggagagcttc

SEQ ID NO: 411815 - DNA, 27 bp, Artificial Sequence
  Description of Artificial Sequence: Synthetic oligonucleotide
cacaactacggggttgcggagagcttc

SEQ ID NO: 411816 - DNA, 28 bp, Artificial Sequence
  Description of Artificial Sequence: Synthetic oligonucleotide
acaactacggggttgcggagagcttcac

SEQ ID NO: 411817 - DNA, 27 bp, Artificial Sequence
  Description of Artificial Sequence: Synthetic oligonucleotide
caactacggggttgcggagagcttcac

SEQ ID NO: 411818 - DNA, 28 bp, Artificial Sequence
  Description of Artificial Sequence: Synthetic oligonucleotide
aactacggggttgcggagagcttcacag

SEQ ID NO: 411819 - DNA, 27 bp, Artificial Sequence
  Description of Artificial Sequence: Synthetic oligonucleotide
actacggggttgcggagagcttcacag

SEQ ID NO: 411820 - DNA, 27 bp, Artificial Sequence
  Description of Artificial Sequence: Synthetic oligonucleotide
ctacggggttgcggagagcttcacagt

SEQ ID NO: 411821 - DNA, 27 bp, Artificial Sequence
  Description of Artificial Sequence: Synthetic oligonucleotide
tacggggttgcggagagcttcacagtg

SEQ ID NO: 411822 - DNA, 26 bp, Artificial Sequence
  Description of Artificial Sequence: Synthetic oligonucleotide
acggggttgcggagagcttcacagtg

SEQ ID NO: 411823 - DNA, 25 bp, Artificial Sequence
  Description of Artificial Sequence: Synthetic oligonucleotide
cggggttgcggagagcttcacagtg

SEQ ID NO: 411824 - DNA, 26 bp, Artificial Sequence
  Description of Artificial Sequence: Synthetic oligonucleotide
ggggttgcggagagcttcacagtgca

SEQ ID NO: 411825 - DNA, 26 bp, Artificial Sequence
  Description of Artificial Sequence: Synthetic oligonucleotide
gggttgcggagagcttcacagtgcag

SEQ ID NO: 411826 - DNA, 26 bp, Artificial Sequence
  Description of Artificial Sequence: Synthetic oligonucleotide
ggttgcggagagcttcacagtgcagc

SEQ ID NO: 411827 - DNA, 26 bp, Artificial Sequence
  Description of Artificial Sequence: Synthetic oligonucleotide
gttgcggagagcttcacagtgcagcg

SEQ ID NO: 411828 - DNA, 26 bp, Artificial Sequence
  Description of Artificial Sequence: Synthetic oligonucleotide
ttgcggagagcttcacagtgcagcgg

SEQ ID NO: 411829 - DNA, 25 bp, Artificial Sequence
  Description of Artificial Sequence: Synthetic oligonucleotide
tgcggagagcttcacagtgcagcgg

SEQ ID NO: 411830 - DNA, 24 bp, Artificial Sequence
  Description of Artificial Sequence: Synthetic oligonucleotide
gcggagagcttcacagtgcagcgg

SEQ ID NO: 411831 - DNA, 24 bp, Artificial Sequence
  Description of Artificial Sequence: Synthetic oligonucleotide
cggagagcttcacagtgcagcggc

SEQ ID NO: 411832 - DNA, 29 bp, Artificial Sequence
  Description of Artificial Sequence: Synthetic oligonucleotide
ccgagtactggaacagccagaaggacttc

SEQ ID NO: 411833 - DNA, 29 bp, Artificial Sequence
  Description of Artificial Sequence: Synthetic oligonucleotide
cgagtactggaacagccagaaggacttcc

SEQ ID NO: 411834 - DNA, 28 bp, Artificial Sequence
  Description of Artificial Sequence: Synthetic oligonucleotide
tggaacagccagaaggacttcctggagc

SEQ ID NO: 411835 - DNA, 27 bp, Artificial Sequence
  Description of Artificial Sequence: Synthetic oligonucleotide
ggaacagccagaaggacttcctggagc

SEQ ID NO: 411836 - DNA, 28 bp, Artificial Sequence
  Description of Artificial Sequence: Synthetic oligonucleotide
gaacagccagaaggacttcctggagcag

SEQ ID NO: 411837 - DNA, 30 bp, Artificial Sequence; identical to SEQ ID NO: 70514
  Description of Artificial Sequence: Synthetic oligonucleotide

SEQ ID NO: 411838 - DNA, 29 bp, Artificial Sequence
  Description of Artificial Sequence: Synthetic oligonucleotide
acagccagaaggacttcctggagcagaag

SEQ ID NO: 411839 - DNA, 28 bp, Artificial Sequence
  Description of Artificial Sequence: Synthetic oligonucleotide
cagccagaaggacttcctggagcagaag

SEQ ID NO: 411840 - DNA, 28 bp, Artificial Sequence
  Description of Artificial Sequence: Synthetic oligonucleotide
agccagaaggacttcctggagcagaagc

SEQ ID NO: 411841 - DNA, 27 bp, Artificial Sequence
  Description of Artificial Sequence: Synthetic oligonucleotide
gccagaaggacttcctggagcagaagc

SEQ ID NO: 411842 - DNA, 27 bp, Artificial Sequence
  Description of Artificial Sequence: Synthetic oligonucleotide
ccagaaggacttcctggagcagaagcg

SEQ ID NO: 411843 - DNA, 27 bp, Artificial Sequence
  Description of Artificial Sequence: Synthetic oligonucleotide
cagaaggacttcctggagcagaagcgg

SEQ ID NO: 411844 - DNA, 27 bp, Artificial Sequence
  Description of Artificial Sequence: Synthetic oligonucleotide
agaaggacttcctggagcagaagcggg

SEQ ID NO: 411845 - DNA, 26 bp, Artificial Sequence
  Description of Artificial Sequence: Synthetic oligonucleotide
gaaggacttcctggagcagaagcggg

SEQ ID NO: 411846 - DNA, 26 bp, Artificial Sequence
  Description of Artificial Sequence: Synthetic oligonucleotide
aaggacttcctggagcagaagcgggg

SEQ ID NO: 411847 - DNA, 25 bp, Artificial Sequence
  Description of Artificial Sequence: Synthetic oligonucleotide
aggacttcctggagcagaagcgggg

SEQ ID NO: 411848 - DNA, 24 bp, Artificial Sequence
  Description of Artificial Sequence: Synthetic oligonucleotide
ggacttcctggagcagaagcgggg

SEQ ID NO: 411849 - DNA, 24 bp, Artificial Sequence
  Description of Artificial Sequence: Synthetic oligonucleotide
gacttcctggagcagaagcggggc

SEQ ID NO: 411850 - DNA, 24 bp, Artificial Sequence
  Description of Artificial Sequence: Synthetic oligonucleotide
acttcctggagcagaagcggggcc

SEQ ID NO: 411851 - DNA, 23 bp, Artificial Sequence
  Description of Artificial Sequence: Synthetic oligonucleotide
cttcctggagcagaagcggggcc

SEQ ID NO: 411852 - DNA, 23 bp, Artificial Sequence
  Description of Artificial Sequence: Synthetic oligonucleotide
ttcctggagcagaagcggggccg

SEQ ID NO: 411853 - DNA, 29 bp, Artificial Sequence
  Description of Artificial Sequence: Synthetic oligonucleotide
atgccgagtactggaagagccagaaggac

SEQ ID NO: 411854 - DNA, 28 bp, Artificial Sequence
  Description of Artificial Sequence: Synthetic oligonucleotide
tgccgagtactggaagagccagaaggac

SEQ ID NO: 411855 - DNA, 27 bp, Artificial Sequence
  Description of Artificial Sequence: Synthetic oligonucleotide
gccgagtactggaagagccagaaggac

SEQ ID NO: 411856 - DNA, 27 bp, Artificial Sequence
  Description of Artificial Sequence: Synthetic oligonucleotide
ccgagtactggaagagccagaaggacc

SEQ ID NO: 411857 - DNA, 28 bp, Artificial Sequence
  Description of Artificial Sequence: Synthetic oligonucleotide
cgagtactggaagagccagaaggacctc

SEQ ID NO: 411858 - DNA, 28 bp, Artificial Sequence
  Description of Artificial Sequence: Synthetic oligonucleotide
gagtactggaagagccagaaggacctcc

SEQ ID NO: 411859 - DNA, 29 bp, Artificial Sequence
  Description of Artificial Sequence: Synthetic oligonucleotide
agtactggaagagccagaaggacctcctg

SEQ ID NO: 411860 - DNA, 28 bp, Artificial Sequence
  Description of Artificial Sequence: Synthetic oligonucleotide
gtactggaagagccagaaggacctcctg

SEQ ID NO: 411861 - DNA, 28 bp, Artificial Sequence
  Description of Artificial Sequence: Synthetic oligonucleotide
tactggaagagccagaaggacctcctgg

SEQ ID NO: 411862 - DNA, 27 bp, Artificial Sequence
  Description of Artificial Sequence: Synthetic oligonucleotide
actggaagagccagaaggacctcctgg

SEQ ID NO: 411863 - DNA, 27 bp, Artificial Sequence
  Description of Artificial Sequence: Synthetic oligonucleotide
ctggaagagccagaaggacctcctgga

SEQ ID NO: 411864 - DNA, 27 bp, Artificial Sequence
  Description of Artificial Sequence: Synthetic oligonucleotide
tggaagagccagaaggacctcctggag

SEQ ID NO: 411865 - DNA, 26 bp, Artificial Sequence
  Description of Artificial Sequence: Synthetic oligonucleotide
ggaagagccagaaggacctcctggag

SEQ ID NO: 411866 - DNA, 27 bp, Artificial Sequence
  Description of Artificial Sequence: Synthetic oligonucleotide
gaagagccagaaggacctcctggagca

SEQ ID NO: 411867 - DNA, 27 bp, Artificial Sequence
  Description of Artificial Sequence: Synthetic oligonucleotide
aagagccagaaggacctcctggagcag

SEQ ID NO: 411868 - DNA, 27 bp, Artificial Sequence
  Description of Artificial Sequence: Synthetic oligonucleotide
agagccagaaggacctcctggagcaga

SEQ ID NO: 411869 - DNA, 27 bp, Artificial Sequence
  Description of Artificial Sequence: Synthetic oligonucleotide
gagccagaaggacctcctggagcagaa

SEQ ID NO: 411870 - DNA, 22 bp, Artificial Sequence
  Description of Artificial Sequence: Synthetic oligonucleotide
ggagcgggtgcggtacctggac

SEQ ID NO: 411871 - DNA, 22 bp, Artificial Sequence
  Description of Artificial Sequence: Synthetic oligonucleotide
gagcgggtgcggtacctggacg

SEQ ID NO: 411872 - DNA, 25 bp, Artificial Sequence
  Description of Artificial Sequence: Synthetic oligonucleotide
agcgggtgcggtacctggacggata

SEQ ID NO: 411873 - DNA, 24 bp, Artificial Sequence
  Description of Artificial Sequence: Synthetic oligonucleotide
gcgggtgcggtacctggacggata

SEQ ID NO: 411874 - DNA, 26 bp, Artificial Sequence
  Description of Artificial Sequence: Synthetic oligonucleotide
cgggtgcggtacctggacggatactt

SEQ ID NO: 411875 - DNA, 26 bp, Artificial Sequence
  Description of Artificial Sequence: Synthetic oligonucleotide
gggtgcggtacctggacggatacttc

SEQ ID NO: 411876 - DNA, 27 bp, Artificial Sequence
  Description of Artificial Sequence: Synthetic oligonucleotide
ggtgcggtacctggacggatacttcca

SEQ ID NO: 411877 - DNA, 30 bp, Artificial Sequence
  Description of Artificial Sequence: Synthetic oligonucleotide
gtgcggtacctggacggatacttccataac

SEQ ID NO: 411878 - DNA, 30 bp, Artificial Sequence
  Description of Artificial Sequence: Synthetic oligonucleotide
tgcggtacctggacggatacttccataacc

SEQ ID NO: 411879 - DNA, 29 bp, Artificial Sequence
  Description of Artificial Sequence: Synthetic oligonucleotide
gcggtacctggacggatacttccataacc

SEQ ID NO: 411880 - DNA, 30 bp, Artificial Sequence
  Description of Artificial Sequence: Synthetic oligonucleotide
cggtacctggacggatacttccataaccag

SEQ ID NO: 411881 - DNA, 30 bp, Artificial Sequence
  Description of Artificial Sequence: Synthetic oligonucleotide
ggtacctggacggatacttccataaccagg

SEQ ID NO: 411882 - DNA, 31 bp, Artificial Sequence
  Description of Artificial Sequence: Synthetic oligonucleotide
gtacctggacggatacttccataaccaggag

SEQ ID NO: 411883 - DNA, 31 bp, Artificial Sequence
  Description of Artificial Sequence: Synthetic oligonucleotide
tacctggacggatacttccataaccaggagg

SEQ ID NO: 411884 - DNA, 30 bp, Artificial Sequence
  Description of Artificial Sequence: Synthetic oligonucleotide
acctggacggatacttccataaccaggagg

SEQ ID NO: 411885 - DNA, 29 bp, Artificial Sequence
  Description of Artificial Sequence: Synthetic oligonucleotide
cctggacggatacttccataaccaggagg

SEQ ID NO: 411886 - DNA, 30 bp, Artificial Sequence
  Description of Artificial Sequence: Synthetic oligonucleotide
ctggacggatacttccataaccaggaggag

SEQ ID NO: 411887 - DNA, 32 bp, Artificial Sequence
  Description of Artificial Sequence: Synthetic oligonucleotide
tggacggatacttccataaccaggaggagaac

SEQ ID NO: 411888 - DNA, 31 bp, Artificial Sequence
  Description of Artificial Sequence: Synthetic oligonucleotide
ggacggatacttccataaccaggaggagaac

SEQ ID NO: 411889 - DNA, 31 bp, Artificial Sequence
  Description of Artificial Sequence: Synthetic oligonucleotide
gacggatacttccataaccaggaggagaacg

SEQ ID NO: 411890 - DNA, 32 bp, Artificial Sequence
  Description of Artificial Sequence: Synthetic oligonucleotide
acggatacttccataaccaggaggagaacgtg

SEQ ID NO: 411891 - DNA, 31 bp, Artificial Sequence
  Description of Artificial Sequence: Synthetic oligonucleotide
cggatacttccataaccaggaggagaacgtg

SEQ ID NO: 411892 - DNA, 31 bp, Artificial Sequence
  Description of Artificial Sequence: Synthetic oligonucleotide
ggatacttccataaccaggaggagaacgtgc

SEQ ID NO: 411893 - DNA, 23 bp, Artificial Sequence
  Description of Artificial Sequence: Synthetic oligonucleotide
gagttccgggcggtgacggaggt

SEQ ID NO: 411894 - DNA, 23 bp, Artificial Sequence
  Description of Artificial Sequence: Synthetic oligonucleotide
agttccgggcggtgacggaggtg

SEQ ID NO: 411895 - DNA, 22 bp, Artificial Sequence
  Description of Artificial Sequence: Synthetic oligonucleotide
gttccgggcggtgacggaggtg

SEQ ID NO: 411896 - DNA, 22 bp, Artificial Sequence
  Description of Artificial Sequence: Synthetic oligonucleotide
ttccgggcggtgacggaggtgg

SEQ ID NO: 411897 - DNA, 21 bp, Artificial Sequence
  Description of Artificial Sequence: Synthetic oligonucleotide
tccgggcggtgacggaggtgg

SEQ ID NO: 411898 - DNA, 20 bp, Artificial Sequence
  Description of Artificial Sequence: Synthetic oligonucleotide
ccgggcggtgacggaggtgg

SEQ ID NO: 411899 - DNA, 20 bp, Artificial Sequence
  Description of Artificial Sequence: Synthetic oligonucleotide
cgggcggtgacggaggtggg

SEQ ID NO: 411900 - DNA, 20 bp, Artificial Sequence
  Description of Artificial Sequence: Synthetic oligonucleotide
gggcggtgacggaggtgggg

SEQ ID NO: 411901 - DNA, 20 bp, Artificial Sequence
  Description of Artificial Sequence: Synthetic oligonucleotide
ggcggtgacggaggtggggc

SEQ ID NO: 411902 - DNA, 20 bp, Artificial Sequence
  Description of Artificial Sequence: Synthetic oligonucleotide
gcggtgacggaggtggggcg

SEQ ID NO: 411903 - DNA, 20 bp, Artificial Sequence
  Description of Artificial Sequence: Synthetic oligonucleotide
cggtgacggaggtggggcgg

SEQ ID NO: 411904 - DNA, 20 bp, Artificial Sequence
  Description of Artificial Sequence: Synthetic oligonucleotide
ggtgacggaggtggggcggc

SEQ ID NO: 411905 - DNA, 21 bp, Artificial Sequence
  Description of Artificial Sequence: Synthetic oligonucleotide
gtgacggaggtggggcggcct

SEQ ID NO: 411906 - DNA, 23 bp, Artificial Sequence
  Description of Artificial Sequence: Synthetic oligonucleotide
tgacggaggtggggcggcctgat

SEQ ID NO: 411907 - DNA, 22 bp, Artificial Sequence
  Description of Artificial Sequence: Synthetic oligonucleotide
gacggaggtggggcggcctgat

SEQ ID NO: 411908 - DNA, 22 bp, Artificial Sequence
  Description of Artificial Sequence: Synthetic oligonucleotide
acggaggtggggcggcctgatg

SEQ ID NO: 411909 - DNA, 21 bp, Artificial Sequence
  Description of Artificial Sequence: Synthetic oligonucleotide
cggaggtggggcggcctgatg

SEQ ID NO: 411910 - DNA, 21 bp, Artificial Sequence
  Description of Artificial Sequence: Synthetic oligonucleotide
ggaggtggggcggcctgatgc

SEQ ID NO: 411911 - DNA, 21 bp, Artificial Sequence
  Description of Artificial Sequence: Synthetic oligonucleotide
gaggtggggcggcctgatgcc

SEQ ID NO: 411912 - DNA, 22 bp, Artificial Sequence
  Description of Artificial Sequence: Synthetic oligonucleotide
aggtggggcggcctgatgccga

SEQ ID NO: 411913 - DNA, 21 bp, Artificial Sequence
  Description of Artificial Sequence: Synthetic oligonucleotide
ggtggggcggcctgatgccga

SEQ ID NO: 411914 - DNA, 23 bp, Artificial Sequence
  Description of Artificial Sequence: Synthetic oligonucleotide
gtggggcggcctgatgccgagta

SEQ ID NO: 411915 - DNA, 22 bp, Artificial Sequence
  Description of Artificial Sequence: Synthetic oligonucleotide
gggagttccgggcggtgacgca

SEQ ID NO: 411916 - DNA, 22 bp, Artificial Sequence
  Description of Artificial Sequence: Synthetic oligonucleotide
ggagttccgggcggtgacgcag

SEQ ID NO: 411917 - DNA, 23 bp, Artificial Sequence
  Description of Artificial Sequence: Synthetic oligonucleotide
gagttccgggcggtgacgcagct

SEQ ID NO: 411918 - DNA, 23 bp, Artificial Sequence
  Description of Artificial Sequence: Synthetic oligonucleotide
agttccgggcggtgacgcagctg

SEQ ID NO: 411919 - DNA, 22 bp, Artificial Sequence
  Description of Artificial Sequence: Synthetic oligonucleotide
gttccgggcggtgacgcagctg

SEQ ID NO: 411920 - DNA, 22 bp, Artificial Sequence
  Description of Artificial Sequence: Synthetic oligonucleotide
ttccgggcggtgacgcagctgg

SEQ ID NO: 411921 - DNA, 21 bp, Artificial Sequence
  Description of Artificial Sequence: Synthetic oligonucleotide
tccgggcggtgacgcagctgg

SEQ ID NO: 411922 - DNA, 20 bp, Artificial Sequence
  Description of Artificial Sequence: Synthetic oligonucleotide
ccgggcggtgacgcagctgg

SEQ ID NO: 411923 - DNA, 20 bp, Artificial Sequence
  Description of Artificial Sequence: Synthetic oligonucleotide
cgggcggtgacgcagctggg

SEQ ID NO: 411924 - DNA, 20 bp, Artificial Sequence
  Description of Artificial Sequence: Synthetic oligonucleotide
gggcggtgacgcagctgggg

SEQ ID NO: 411925 - DNA, 20 bp, Artificial Sequence
  Description of Artificial Sequence: Synthetic oligonucleotide
ggcggtgacgcagctggggc

SEQ ID NO: 411926 - DNA, 20 bp, Artificial Sequence
  Description of Artificial Sequence: Synthetic oligonucleotide
gcggtgacgcagctggggcg

SEQ ID NO: 411927 - DNA, 20 bp, Artificial Sequence
  Description of Artificial Sequence: Synthetic oligonucleotide
cggtgacgcagctggggcgg

SEQ ID NO: 411928 - DNA, 20 bp, Artificial Sequence
  Description of Artificial Sequence: Synthetic oligonucleotide
ggtgacgcagctggggcggc

SEQ ID NO: 411929 - DNA, 21 bp, Artificial Sequence
  Description of Artificial Sequence: Synthetic oligonucleotide
gtgacgcagctggggcggcct

SEQ ID NO: 411930 - DNA, 23 bp, Artificial Sequence
  Description of Artificial Sequence: Synthetic oligonucleotide
tgacgcagctggggcggcctgat

SEQ ID NO: 411931 - DNA, 22 bp, Artificial Sequence
  Description of Artificial Sequence: Synthetic oligonucleotide
gacgcagctggggcggcctgat

SEQ ID NO: 411932 - DNA, 22 bp, Artificial Sequence
  Description of Artificial Sequence: Synthetic oligonucleotide
acgcagctggggcggcctgatg

SEQ ID NO: 411933 - DNA, 21 bp, Artificial Sequence
  Description of Artificial Sequence: Synthetic oligonucleotide
cgcagctggggcggcctgatg

SEQ ID NO: 411934 - DNA, 21 bp, Artificial Sequence
  Description of Artificial Sequence: Synthetic oligonucleotide
gcagctggggcggcctgatgc

SEQ ID NO: 411935 - DNA, 21 bp, Artificial Sequence
  Description of Artificial Sequence: Synthetic oligonucleotide
cagctggggcggcctgatgcc

SEQ ID NO: 411936 - DNA, 22 bp, Artificial Sequence
  Description of Artificial Sequence: Synthetic oligonucleotide
agctggggcggcctgatgccca

SEQ ID NO: 411937 - DNA, 21 bp, Artificial Sequence
  Description of Artificial Sequence: Synthetic oligonucleotide
gctggggcggcctgatgccca

SEQ ID NO: 411938 - DNA, 23 bp, Artificial Sequence
  Description of Artificial Sequence: Synthetic oligonucleotide
ctggggcggcctgatgcccagta

SEQ ID NO: 411939 - DNA, 24 bp, Artificial Sequence
  Description of Artificial Sequence: Synthetic oligonucleotide
tggggcggcctgatgcccagtact

SEQ ID NO: 411940 - DNA, 23 bp, Artificial Sequence
  Description of Artificial Sequence: Synthetic oligonucleotide
ggggcggcctgatgcccagtact

SEQ ID NO: 411941 - DNA, 23 bp, Artificial Sequence
  Description of Artificial Sequence: Synthetic oligonucleotide
gggcggcctgatgcccagtactg

SEQ ID NO: 411942 - DNA, 25 bp, Artificial Sequence
  Description of Artificial Sequence: Synthetic oligonucleotide
ggcggcctgatgcccagtactggaa

SEQ ID NO: 411943 - DNA, 26 bp, Artificial Sequence
  Description of Artificial Sequence: Synthetic oligonucleotide
gcggcctgatgcccagtactggaaca

SEQ ID NO: 411944 - DNA, 26 bp, Artificial Sequence
  Description of Artificial Sequence: Synthetic oligonucleotide
cggcctgatgcccagtactggaacag

SEQ ID NO: 411945 - DNA, 26 bp, Artificial Sequence
  Description of Artificial Sequence: Synthetic oligonucleotide
ggcctgatgcccagtactggaacagc

SEQ ID NO: 411946 - DNA, 27 bp, Artificial Sequence
  Description of Artificial Sequence: Synthetic oligonucleotide
gcctgatgcccagtactggaacagcca

SEQ ID NO: 411947 - DNA, 27 bp, Artificial Sequence
  Description of Artificial Sequence: Synthetic oligonucleotide
cctgatgcccagtactggaacagccag

SEQ ID NO: 411948 - DNA, 29 bp, Artificial Sequence
  Description of Artificial Sequence: Synthetic oligonucleotide
ctgatgcccagtactggaacagccagaag

SEQ ID NO: 411949 - DNA, 29 bp, Artificial Sequence
  Description of Artificial Sequence: Synthetic oligonucleotide
tgatgcccagtactggaacagccagaagg

SEQ ID NO: 411950 - DNA, 28 bp, Artificial Sequence
  Description of Artificial Sequence: Synthetic oligonucleotide
gatgcccagtactggaacagccagaagg

SEQ ID NO: 411951 - DNA, 29 bp, Artificial Sequence
  Description of Artificial Sequence: Synthetic oligonucleotide
atgcccagtactggaacagccagaaggac

SEQ ID NO: 411952 - DNA, 28 bp, Artificial Sequence
  Description of Artificial Sequence: Synthetic oligonucleotide
tgcccagtactggaacagccagaaggac

SEQ ID NO: 411953 - DNA, 27 bp, Artificial Sequence
  Description of Artificial Sequence: Synthetic oligonucleotide
gcccagtactggaacagccagaaggac

SEQ ID NO: 411954 - DNA, 27 bp, Artificial Sequence
  Description of Artificial Sequence: Synthetic oligonucleotide
cccagtactggaacagccagaaggacc

SEQ ID NO: 411955 - DNA, 28 bp, Artificial Sequence
  Description of Artificial Sequence: Synthetic oligonucleotide
ccagtactggaacagccagaaggacctc

SEQ ID NO: 411956 - DNA, 28 bp, Artificial Sequence
  Description of Artificial Sequence: Synthetic oligonucleotide
cagtactggaacagccagaaggacctcc

SEQ ID NO: 411957 - DNA, 29 bp, Artificial Sequence
  Description of Artificial Sequence: Synthetic oligonucleotide
atggtgtgtctgaagttccctggaggctc

SEQ ID NO: 411958 - DNA, 28 bp, Artificial Sequence
  Description of Artificial Sequence: Synthetic oligonucleotide
tggtgtgtctgaagttccctggaggctc

SEQ ID NO: 411959 - DNA, 27 bp, Artificial Sequence
  Description of Artificial Sequence: Synthetic oligonucleotide
ggtgtgtctgaagttccctggaggctc

SEQ ID NO: 411960 - DNA, 27 bp, Artificial Sequence
  Description of Artificial Sequence: Synthetic oligonucleotide
gtgtgtctgaagttccctggaggctcc

SEQ ID NO: 411961 - DNA, 28 bp, Artificial Sequence
  Description of Artificial Sequence: Synthetic oligonucleotide
tgtgtctgaagttccctggaggctcctg

SEQ ID NO: 411962 - DNA, 27 bp, Artificial Sequence
  Description of Artificial Sequence: Synthetic oligonucleotide
gtgtctgaagttccctggaggctcctg

SEQ ID NO: 411963 - DNA, 27 bp, Artificial Sequence
  Description of Artificial Sequence: Synthetic oligonucleotide
tgtctgaagttccctggaggctcctgc

SEQ ID NO: 411964 - DNA, 27 bp, Artificial Sequence
  Description of Artificial Sequence: Synthetic oligonucleotide
gtctgaagttccctggaggctcctgca

SEQ ID NO: 411965 - DNA, 28 bp, Artificial Sequence
  Description of Artificial Sequence: Synthetic oligonucleotide
tctgaagttccctggaggctcctgcatg

SEQ ID NO: 411966 - DNA, 27 bp, Artificial Sequence
  Description of Artificial Sequence: Synthetic oligonucleotide
ctgaagttccctggaggctcctgcatg

SEQ ID NO: 411967 - DNA, 27 bp, Artificial Sequence
  Description of Artificial Sequence: Synthetic oligonucleotide
tgaagttccctggaggctcctgcatgg

SEQ ID NO: 411968 - DNA, 26 bp, Artificial Sequence
  Description of Artificial Sequence: Synthetic oligonucleotide
gaagttccctggaggctcctgcatgg

SEQ ID NO: 411969 - DNA, 27 bp, Artificial Sequence
  Description of Artificial Sequence: Synthetic oligonucleotide
aagttccctggaggctcctgcatggca

SEQ ID NO: 411970 - DNA, 26 bp, Artificial Sequence
  Description of Artificial Sequence: Synthetic oligonucleotide
agttccctggaggctcctgcatggca

SEQ ID NO: 411971 - DNA, 25 bp, Artificial Sequence
  Description of Artificial Sequence: Synthetic oligonucleotide
gttccctggaggctcctgcatggca

SEQ ID NO: 411972 - DNA, 25 bp, Artificial Sequence
  Description of Artificial Sequence: Synthetic oligonucleotide
ttccctggaggctcctgcatggcag

SEQ ID NO: 411973 - DNA, 24 bp, Artificial Sequence
  Description of Artificial Sequence: Synthetic oligonucleotide
tccctggaggctcctgcatggcag

SEQ ID NO: 411974 - DNA, 23 bp, Artificial Sequence
  Description of Artificial Sequence: Synthetic oligonucleotide
ccctggaggctcctgcatggcag

SEQ ID NO: 411975 - DNA, 24 bp, Artificial Sequence
  Description of Artificial Sequence: Synthetic oligonucleotide
cctggaggctcctgcatggcagct

SEQ ID NO: 411976 - DNA, 25 bp, Artificial Sequence
  Description of Artificial Sequence: Synthetic oligonucleotide
ctggaggctcctgcatggcagctct

SEQ ID NO: 411977 - DNA, 26 bp, Artificial Sequence
  Description of Artificial Sequence: Synthetic oligonucleotide
tggaggctcctgcatggcagctctga

SEQ ID NO: 411978 - DNA, 25 bp, Artificial Sequence
  Description of Artificial Sequence: Synthetic oligonucleotide
ggaggctcctgcatggcagctctga

SEQ ID NO: 411979 - DNA, 26 bp, Artificial Sequence
  Description of Artificial Sequence: Synthetic oligonucleotide
gaggctcctgcatggcagctctgaca

SEQ ID NO: 411980 - DNA, 27 bp, Artificial Sequence
  Description of Artificial Sequence: Synthetic oligonucleotide
aggctcctgcatggcagctctgacagt

SEQ ID NO: 411981 - DNA, 26 bp, Artificial Sequence
  Description of Artificial Sequence: Synthetic oligonucleotide
ggctcctgcatggcagctctgacagt

SEQ ID NO: 411982 - DNA, 27 bp, Artificial Sequence
  Description of Artificial Sequence: Synthetic oligonucleotide
gctcctgcatggcagctctgacagtga

SEQ ID NO: 411983 - DNA, 27 bp, Artificial Sequence
  Description of Artificial Sequence: Synthetic oligonucleotide
ctcctgcatggcagctctgacagtgac

SEQ ID NO: 411984 - DNA, 28 bp, Artificial Sequence
  Description of Artificial Sequence: Synthetic oligonucleotide
tcctgcatggcagctctgacagtgacac

SEQ ID NO: 411985 - DNA, 27 bp, Artificial Sequence
  Description of Artificial Sequence: Synthetic oligonucleotide
cctgcatggcagctctgacagtgacac

SEQ ID NO: 411986 - DNA, 28 bp, Artificial Sequence
  Description of Artificial Sequence: Synthetic oligonucleotide
ctgcatggcagctctgacagtgacactg

SEQ ID NO: 411987 - DNA, 30 bp, Artificial Sequence; identical to SEQ ID NO: 66363
  Description of Artificial Sequence: Synthetic oligonucleotide

SEQ ID NO: 411988 - DNA, 29 bp, Artificial Sequence
  Description of Artificial Sequence: Synthetic oligonucleotide
gcatggcagctctgacagtgacactgatg

SEQ ID NO: 411989 - DNA, 29 bp, Artificial Sequence
  Description of Artificial Sequence: Synthetic oligonucleotide
catggcagctctgacagtgacactgatgg

SEQ ID NO: 411990 - DNA, 30 bp, Artificial Sequence; identical to SEQ ID NO: 66366
  Description of Artificial Sequence: Synthetic oligonucleotide

SEQ ID NO: 411991 - DNA, 29 bp, Artificial Sequence
  Description of Artificial Sequence: Synthetic oligonucleotide
tggcagctctgacagtgacactgatggtg

SEQ ID NO: 411992 - DNA, 28 bp, Artificial Sequence
  Description of Artificial Sequence: Synthetic oligonucleotide
ggcagctctgacagtgacactgatggtg

SEQ ID NO: 411993 - DNA, 28 bp, Artificial Sequence
  Description of Artificial Sequence: Synthetic oligonucleotide
gcagctctgacagtgacactgatggtgc

SEQ ID NO: 411994 - DNA, 29 bp, Artificial Sequence
  Description of Artificial Sequence: Synthetic oligonucleotide
cagctctgacagtgacactgatggtgctg

SEQ ID NO: 411995 - DNA, 30 bp, Artificial Sequence; identical to SEQ ID NO: 66371
  Description of Artificial Sequence: Synthetic oligonucleotide

SEQ ID NO: 411996 - DNA, 29 bp, Artificial Sequence
  Description of Artificial Sequence: Synthetic oligonucleotide
gctctgacagtgacactgatggtgctgag

SEQ ID NO: 411997 - DNA, 29 bp, Artificial Sequence
  Description of Artificial Sequence: Synthetic oligonucleotide
ctctgacagtgacactgatggtgctgagc

SEQ ID NO: 411998 - DNA, 26 bp, Artificial Sequence
  Description of Artificial Sequence: Synthetic oligonucleotide
ctggggacacccgaccacgtttcttg

SEQ ID NO: 411999 - DNA, 27 bp, Artificial Sequence
  Description of Artificial Sequence: Synthetic oligonucleotide
tggggacacccgaccacgtttcttgga

SEQ ID NO: 412000 - DNA, 26 bp, Artificial Sequence
  Description of Artificial Sequence: Synthetic oligonucleotide
ggggacacccgaccacgtttcttgga

SEQ ID NO: 412001 - DNA, 26 bp, Artificial Sequence
  Description of Artificial Sequence: Synthetic oligonucleotide
gggacacccgaccacgtttcttggag

SEQ ID NO: 412002 - DNA, 27 bp, Artificial Sequence
  Description of Artificial Sequence: Synthetic oligonucleotide
ggacacccgaccacgtttcttggagca

SEQ ID NO: 412003 - DNA, 27 bp, Artificial Sequence
  Description of Artificial Sequence: Synthetic oligonucleotide
gacacccgaccacgtttcttggagcag

SEQ ID NO: 412004 - DNA, 27 bp, Artificial Sequence
  Description of Artificial Sequence: Synthetic oligonucleotide
acacccgaccacgtttcttggagcagg

SEQ ID NO: 412005 - DNA, 27 bp, Artificial Sequence
  Description of Artificial Sequence: Synthetic oligonucleotide
cacccgaccacgtttcttggagcaggt

SEQ ID NO: 412006 - DNA, 31 bp, Artificial Sequence; identical to SEQ ID NO: 66382
  Description of Artificial Sequence: Synthetic oligonucleotide

SEQ ID NO: 412007 - DNA, 30 bp, Artificial Sequence; identical to SEQ ID NO: 66383
  Description of Artificial Sequence: Synthetic oligonucleotide

SEQ ID NO: 412008 - DNA, 32 bp, Artificial Sequence; identical to SEQ ID NO: 66384
  Description of Artificial Sequence: Synthetic oligonucleotide

SEQ ID NO: 412009 - DNA, 33 bp, Artificial Sequence; identical to SEQ ID NO: 66385
  Description of Artificial Sequence: Synthetic oligonucleotide

SEQ ID NO: 412010 - DNA, 34 bp, Artificial Sequence; identical to SEQ ID NO: 66386
  Description of Artificial Sequence: Synthetic oligonucleotide

SEQ ID NO: 412011 - DNA, 35 bp, Artificial Sequence; identical to SEQ ID NO: 66387
  Description of Artificial Sequence: Synthetic oligonucleotide

SEQ ID NO: 412012 - DNA, 34 bp, Artificial Sequence; identical to SEQ ID NO: 66388
  Description of Artificial Sequence: Synthetic oligonucleotide

SEQ ID NO: 412013 - DNA, 38 bp, Artificial Sequence; identical to SEQ ID NO: 66389
  Description of Artificial Sequence: Synthetic oligonucleotide

SEQ ID NO: 412014 - DNA, 40 bp, Artificial Sequence; identical to SEQ ID NO: 66390
  Description of Artificial Sequence: Synthetic oligonucleotide

SEQ ID NO: 412015 - DNA, 39 bp, Artificial Sequence; identical to SEQ ID NO: 66391
  Description of Artificial Sequence: Synthetic oligonucleotide

SEQ ID NO: 412016 - DNA, 41 bp, Artificial Sequence; identical to SEQ ID NO: 66392
  Description of Artificial Sequence: Synthetic oligonucleotide

SEQ ID NO: 412017 - DNA, 41 bp, Artificial Sequence; identical to SEQ ID NO: 66393
  Description of Artificial Sequence: Synthetic oligonucleotide

SEQ ID NO: 412018 - DNA, 40 bp, Artificial Sequence; identical to SEQ ID NO: 66394
  Description of Artificial Sequence: Synthetic oligonucleotide

SEQ ID NO: 412019 - DNA, 39 bp, Artificial Sequence; identical to SEQ ID NO: 66395
  Description of Artificial Sequence: Synthetic oligonucleotide

SEQ ID NO: 412020 - DNA, 38 bp, Artificial Sequence; identical to SEQ ID NO: 66396
  Description of Artificial Sequence: Synthetic oligonucleotide

SEQ ID NO: 412021 - DNA, 38 bp, Artificial Sequence; identical to SEQ ID NO: 66397
  Description of Artificial Sequence: Synthetic oligonucleotide

SEQ ID NO: 412022 - DNA, 37 bp, Artificial Sequence; identical to SEQ ID NO: 66398
  Description of Artificial Sequence: Synthetic oligonucleotide

SEQ ID NO: 412023 - DNA, 36 bp, Artificial Sequence; identical to SEQ ID NO: 66399
  Description of Artificial Sequence: Synthetic oligonucleotide

SEQ ID NO: 412024 - DNA, 36 bp, Artificial Sequence; identical to SEQ ID NO: 66400
  Description of Artificial Sequence: Synthetic oligonucleotide

SEQ ID NO: 412025 - DNA, 37 bp, Artificial Sequence; identical to SEQ ID NO: 66401
  Description of Artificial Sequence: Synthetic oligonucleotide

SEQ ID NO: 412026 - DNA, 36 bp, Artificial Sequence; identical to SEQ ID NO: 66402
  Description of Artificial Sequence: Synthetic oligonucleotide

SEQ ID NO: 412027 - DNA, 36 bp, Artificial Sequence; identical to SEQ ID NO: 66403
  Description of Artificial Sequence: Synthetic oligonucleotide

SEQ ID NO: 412028 - DNA, 36 bp, Artificial Sequence; identical to SEQ ID NO: 66404
  Description of Artificial Sequence: Synthetic oligonucleotide

SEQ ID NO: 412029 - DNA, 35 bp, Artificial Sequence; identical to SEQ ID NO: 66405
  Description of Artificial Sequence: Synthetic oligonucleotide

SEQ ID NO: 412030 - DNA, 36 bp, Artificial Sequence; identical to SEQ ID NO: 66406
  Description of Artificial Sequence: Synthetic oligonucleotide

SEQ ID NO: 412031 - DNA, 36 bp, Artificial Sequence; identical to SEQ ID NO: 66407
  Description of Artificial Sequence: Synthetic oligonucleotide

SEQ ID NO: 412032 - DNA, 35 bp, Artificial Sequence; identical to SEQ ID NO: 66408
  Description of Artificial Sequence: Synthetic oligonucleotide

SEQ ID NO: 412033 - DNA, 34 bp, Artificial Sequence; identical to SEQ ID NO: 66409
  Description of Artificial Sequence: Synthetic oligonucleotide

SEQ ID NO: 412034 - DNA, 33 bp, Artificial Sequence; identical to SEQ ID NO: 66410
  Description of Artificial Sequence: Synthetic oligonucleotide

SEQ ID NO: 412035 - DNA, 32 bp, Artificial Sequence; identical to SEQ ID NO: 66411
  Description of Artificial Sequence: Synthetic oligonucleotide

SEQ ID NO: 412036 - DNA, 31 bp, Artificial Sequence; identical to SEQ ID NO: 66412
  Description of Artificial Sequence: Synthetic oligonucleotide

SEQ ID NO: 412037 - DNA, 31 bp, Artificial Sequence; identical to SEQ ID NO: 66413
  Description of Artificial Sequence: Synthetic oligonucleotide

SEQ ID NO: 412038 - DNA, 30 bp, Artificial Sequence; identical to SEQ ID NO: 66414
  Description of Artificial Sequence: Synthetic oligonucleotide

SEQ ID NO: 412039 - DNA, 29 bp, Artificial Sequence
  Description of Artificial Sequence: Synthetic oligonucleotide
gagtgtcatttcttcaacgggacggagcg

SEQ ID NO: 412040 - DNA, 29 bp, Artificial Sequence
  Description of Artificial Sequence: Synthetic oligonucleotide
agtgtcatttcttcaacgggacggagcgg

SEQ ID NO: 412041 - DNA, 28 bp, Artificial Sequence
  Description of Artificial Sequence: Synthetic oligonucleotide
gtgtcatttcttcaacgggacggagcgg

SEQ ID NO: 412042 - DNA, 26 bp, Artificial Sequence
  Description of Artificial Sequence: Synthetic oligonucleotide
tttcttcaacgggacggagcgggtgc

SEQ ID NO: 412043 - DNA, 25 bp, Artificial Sequence
  Description of Artificial Sequence: Synthetic oligonucleotide
ttcttcaacgggacggagcgggtgc

SEQ ID NO: 412044 - DNA, 24 bp, Artificial Sequence
  Description of Artificial Sequence: Synthetic oligonucleotide
tcttcaacgggacggagcgggtgc

SEQ ID NO: 412045 - DNA, 23 bp, Artificial Sequence
  Description of Artificial Sequence: Synthetic oligonucleotide
cttcaacgggacggagcgggtgc

SEQ ID NO: 412046 - DNA, 23 bp, Artificial Sequence
  Description of Artificial Sequence: Synthetic oligonucleotide
ttcaacgggacggagcgggtgcg

SEQ ID NO: 412047 - DNA, 22 bp, Artificial Sequence
  Description of Artificial Sequence: Synthetic oligonucleotide
tcaacgggacggagcgggtgcg

SEQ ID NO: 412048 - DNA, 21 bp, Artificial Sequence
  Description of Artificial Sequence: Synthetic oligonucleotide
caacgggacggagcgggtgcg

SEQ ID NO: 412049 - DNA, 23 bp, Artificial Sequence
  Description of Artificial Sequence: Synthetic oligonucleotide
aacgggacggagcgggtgcggtt

SEQ ID NO: 412050 - DNA, 22 bp, Artificial Sequence
  Description of Artificial Sequence: Synthetic oligonucleotide
acgggacggagcgggtgcggtt

SEQ ID NO: 412051 - DNA, 21 bp, Artificial Sequence
  Description of Artificial Sequence: Synthetic oligonucleotide
cgggacggagcgggtgcggtt

SEQ ID NO: 412052 - DNA, 27 bp, Artificial Sequence
  Description of Artificial Sequence: Synthetic oligonucleotide
agagcttcacagtgcagcggcgagtct

SEQ ID NO: 412053 - DNA, 27 bp, Artificial Sequence
  Description of Artificial Sequence: Synthetic oligonucleotide
gagcttcacagtgcagcggcgagtcta

SEQ ID NO: 412054 - DNA, 28 bp, Artificial Sequence
  Description of Artificial Sequence: Synthetic oligonucleotide
agcttcacagtgcagcggcgagtctatc

SEQ ID NO: 412055 - DNA, 27 bp, Artificial Sequence
  Description of Artificial Sequence: Synthetic oligonucleotide
gcttcacagtgcagcggcgagtctatc

SEQ ID NO: 412056 - DNA, 27 bp, Artificial Sequence
  Description of Artificial Sequence: Synthetic oligonucleotide
cttcacagtgcagcggcgagtctatcc

SEQ ID NO: 412057 - DNA, 28 bp, Artificial Sequence
  Description of Artificial Sequence: Synthetic oligonucleotide
ttcacagtgcagcggcgagtctatcctg

SEQ ID NO: 412058 - DNA, 27 bp, Artificial Sequence
  Description of Artificial Sequence: Synthetic oligonucleotide
tcacagtgcagcggcgagtctatcctg

SEQ ID NO: 412059 - DNA, 27 bp, Artificial Sequence
  Description of Artificial Sequence: Synthetic oligonucleotide
cacagtgcagcggcgagtctatcctga

SEQ ID NO: 412060 - DNA, 27 bp, Artificial Sequence
  Description of Artificial Sequence: Synthetic oligonucleotide
acagtgcagcggcgagtctatcctgag

SEQ ID NO: 412061 - DNA, 26 bp, Artificial Sequence
  Description of Artificial Sequence: Synthetic oligonucleotide
cagtgcagcggcgagtctatcctgag

SEQ ID NO: 412062 - DNA, 27 bp, Artificial Sequence
  Description of Artificial Sequence: Synthetic oligonucleotide
agtgcagcggcgagtctatcctgaggt

SEQ ID NO: 412063 - DNA, 26 bp, Artificial Sequence
  Description of Artificial Sequence: Synthetic oligonucleotide
gtgcagcggcgagtctatcctgaggt

SEQ ID NO: 412064 - DNA, 27 bp, Artificial Sequence
  Description of Artificial Sequence: Synthetic oligonucleotide
tgcagcggcgagtctatcctgaggtga

SEQ ID NO: 412065 - DNA, 26 bp, Artificial Sequence
  Description of Artificial Sequence: Synthetic oligonucleotide
gcagcggcgagtctatcctgaggtga

SEQ ID NO: 412066 - DNA, 27 bp, Artificial Sequence
  Description of Artificial Sequence: Synthetic oligonucleotide
cagcggcgagtctatcctgaggtgact

SEQ ID NO: 412067 - DNA, 27 bp, Artificial Sequence
  Description of Artificial Sequence: Synthetic oligonucleotide
agcggcgagtctatcctgaggtgactg

SEQ ID NO: 412068 - DNA, 27 bp, Artificial Sequence
  Description of Artificial Sequence: Synthetic oligonucleotide
gcggcgagtctatcctgaggtgactgt

SEQ ID NO: 412069 - DNA, 27 bp, Artificial Sequence
  Description of Artificial Sequence: Synthetic oligonucleotide
cggcgagtctatcctgaggtgactgtg

SEQ ID NO: 412070 - DNA, 30 bp, Artificial Sequence; identical to SEQ ID NO: 66446
  Description of Artificial Sequence: Synthetic oligonucleotide

SEQ ID NO: 412071 - DNA, 30 bp, Artificial Sequence; identical to SEQ ID NO: 66447
  Description of Artificial Sequence: Synthetic oligonucleotide

SEQ ID NO: 412072 - DNA, 31 bp, Artificial Sequence; identical to SEQ ID NO: 66448
  Description of Artificial Sequence: Synthetic oligonucleotide

SEQ ID NO: 412073 - DNA, 31 bp, Artificial Sequence; identical to SEQ ID NO: 66449
  Description of Artificial Sequence: Synthetic oligonucleotide

SEQ ID NO: 412074 - DNA, 34 bp, Artificial Sequence; identical to SEQ ID NO: 66450
  Description of Artificial Sequence: Synthetic oligonucleotide

SEQ ID NO: 412075 - DNA, 33 bp, Artificial Sequence; identical to SEQ ID NO: 66451
  Description of Artificial Sequence: Synthetic oligonucleotide

SEQ ID NO: 412076 - DNA, 34 bp, Artificial Sequence; identical to SEQ ID NO: 66452
  Description of Artificial Sequence: Synthetic oligonucleotide

SEQ ID NO: 412077 - DNA, 33 bp, Artificial Sequence; identical to SEQ ID NO: 66453
  Description of Artificial Sequence: Synthetic oligonucleotide

SEQ ID NO: 412078 - DNA, 33 bp, Artificial Sequence; identical to SEQ ID NO: 66454
  Description of Artificial Sequence: Synthetic oligonucleotide

SEQ ID NO: 412079 - DNA, 32 bp, Artificial Sequence; identical to SEQ ID NO: 66455
  Description of Artificial Sequence: Synthetic oligonucleotide

SEQ ID NO: 412080 - DNA, 31 bp, Artificial Sequence; identical to SEQ ID NO: 66456
  Description of Artificial Sequence: Synthetic oligonucleotide

SEQ ID NO: 412081 - DNA, 30 bp, Artificial Sequence; identical to SEQ ID NO: 66457
  Description of Artificial Sequence: Synthetic oligonucleotide

SEQ ID NO: 412082 - DNA, 30 bp, Artificial Sequence; identical to SEQ ID NO: 66458
  Description of Artificial Sequence: Synthetic oligonucleotide

SEQ ID NO: 412083 - DNA, 31 bp, Artificial Sequence; identical to SEQ ID NO: 66459
  Description of Artificial Sequence: Synthetic oligonucleotide

SEQ ID NO: 412084 - DNA, 30 bp, Artificial Sequence; identical to SEQ ID NO: 66460
  Description of Artificial Sequence: Synthetic oligonucleotide

SEQ ID NO: 412085 - DNA, 30 bp, Artificial Sequence; identical to SEQ ID NO: 66461
  Description of Artificial Sequence: Synthetic oligonucleotide

SEQ ID NO: 412086 - DNA, 29 bp, Artificial Sequence
  Description of Artificial Sequence: Synthetic oligonucleotide
ggtgactgtgtatcctgcaaagacccagc

SEQ ID NO: 412087 - DNA, 29 bp, Artificial Sequence
  Description of Artificial Sequence: Synthetic oligonucleotide
gtgactgtgtatcctgcaaagacccagcc

SEQ ID NO: 412088 - DNA, 29 bp, Artificial Sequence
  Description of Artificial Sequence: Synthetic oligonucleotide
tgactgtgtatcctgcaaagacccagccc

SEQ ID NO: 412089 - DNA, 28 bp, Artificial Sequence
  Description of Artificial Sequence: Synthetic oligonucleotide
gactgtgtatcctgcaaagacccagccc

SEQ ID NO: 412090 - DNA, 28 bp, Artificial Sequence
  Description of Artificial Sequence: Synthetic oligonucleotide
actgtgtatcctgcaaagacccagcccc

SEQ ID NO: 412091 - DNA, 27 bp, Artificial Sequence
  Description of Artificial Sequence: Synthetic oligonucleotide
ctgtgtatcctgcaaagacccagcccc

SEQ ID NO: 412092 - DNA, 28 bp, Artificial Sequence
  Description of Artificial Sequence: Synthetic oligonucleotide
tgtgtatcctgcaaagacccagcccctg

SEQ ID NO: 412093 - DNA, 27 bp, Artificial Sequence
  Description of Artificial Sequence: Synthetic oligonucleotide
gtgtatcctgcaaagacccagcccctg

SEQ ID NO: 412094 - DNA, 27 bp, Artificial Sequence
  Description of Artificial Sequence: Synthetic oligonucleotide
tgtatcctgcaaagacccagcccctgc

SEQ ID NO: 412095 - DNA, 27 bp, Artificial Sequence
  Description of Artificial Sequence: Synthetic oligonucleotide
gtatcctgcaaagacccagcccctgca

SEQ ID NO: 412096 - DNA, 27 bp, Artificial Sequence
  Description of Artificial Sequence: Synthetic oligonucleotide
tatcctgcaaagacccagcccctgcag

SEQ ID NO: 412097 - DNA, 26 bp, Artificial Sequence
  Description of Artificial Sequence: Synthetic oligonucleotide
atcctgcaaagacccagcccctgcag

SEQ ID NO: 412098 - DNA, 25 bp, Artificial Sequence
  Description of Artificial Sequence: Synthetic oligonucleotide
tcctgcaaagacccagcccctgcag

SEQ ID NO: 412099 - DNA, 24 bp, Artificial Sequence
  Description of Artificial Sequence: Synthetic oligonucleotide
cctgcaaagacccagcccctgcag

SEQ ID NO: 412100 - DNA, 25 bp, Artificial Sequence
  Description of Artificial Sequence: Synthetic oligonucleotide
ctgcaaagacccagcccctgcagca

SEQ ID NO: 412101 - DNA, 25 bp, Artificial Sequence
  Description of Artificial Sequence: Synthetic oligonucleotide
tgcaaagacccagcccctgcagcac

SEQ ID NO: 412102 - DNA, 24 bp, Artificial Sequence
  Description of Artificial Sequence: Synthetic oligonucleotide
gcaaagacccagcccctgcagcac

SEQ ID NO: 412103 - DNA, 30 bp, Artificial Sequence; identical to SEQ ID NO: 66479
  Description of Artificial Sequence: Synthetic oligonucleotide

SEQ ID NO: 412104 - DNA, 29 bp, Artificial Sequence
  Description of Artificial Sequence: Synthetic oligonucleotide
ccacaacctcctggtctgctctgtgaatg

SEQ ID NO: 412105 - DNA, 29 bp, Artificial Sequence
  Description of Artificial Sequence: Synthetic oligonucleotide
cacaacctcctggtctgctctgtgaatgg

SEQ ID NO: 412106 - DNA, 32 bp, Artificial Sequence; identical to SEQ ID NO: 66482
  Description of Artificial Sequence: Synthetic oligonucleotide

SEQ ID NO: 412107 - DNA, 31 bp, Artificial Sequence; identical to SEQ ID NO: 66483
  Description of Artificial Sequence: Synthetic oligonucleotide

SEQ ID NO: 412108 - DNA, 34 bp, Artificial Sequence; identical to SEQ ID NO: 66484
  Description of Artificial Sequence: Synthetic oligonucleotide

SEQ ID NO: 412109 - DNA, 33 bp, Artificial Sequence; identical to SEQ ID NO: 66485
  Description of Artificial Sequence: Synthetic oligonucleotide

SEQ ID NO: 412110 - DNA, 32 bp, Artificial Sequence; identical to SEQ ID NO: 66486
  Description of Artificial Sequence: Synthetic oligonucleotide

SEQ ID NO: 412111 - DNA, 32 bp, Artificial Sequence; identical to SEQ ID NO: 66487
  Description of Artificial Sequence: Synthetic oligonucleotide

SEQ ID NO: 412112 - DNA, 33 bp, Artificial Sequence; identical to SEQ ID NO: 66488
  Description of Artificial Sequence: Synthetic oligonucleotide

SEQ ID NO: 412113 - DNA, 32 bp, Artificial Sequence; identical to SEQ ID NO: 66489
  Description of Artificial Sequence: Synthetic oligonucleotide

SEQ ID NO: 412114 - DNA, 32 bp, Artificial Sequence; identical to SEQ ID NO: 66490
  Description of Artificial Sequence: Synthetic oligonucleotide

SEQ ID NO: 412115 - DNA, 32 bp, Artificial Sequence; identical to SEQ ID NO: 66491
  Description of Artificial Sequence: Synthetic oligonucleotide

SEQ ID NO: 412116 - DNA, 31 bp, Artificial Sequence; identical to SEQ ID NO: 66492
  Description of Artificial Sequence: Synthetic oligonucleotide

SEQ ID NO: 412117 - DNA, 32 bp, Artificial Sequence; identical to SEQ ID NO: 66493
  Description of Artificial Sequence: Synthetic oligonucleotide

SEQ ID NO: 412118 - DNA, 32 bp, Artificial Sequence; identical to SEQ ID NO: 66494
  Description of Artificial Sequence: Synthetic oligonucleotide

SEQ ID NO: 412119 - DNA, 31 bp, Artificial Sequence; identical to SEQ ID NO: 66495
  Description of Artificial Sequence: Synthetic oligonucleotide

SEQ ID NO: 412120 - DNA, 34 bp, Artificial Sequence; identical to SEQ ID NO: 66496
  Description of Artificial Sequence: Synthetic oligonucleotide

SEQ ID NO: 412121 - DNA, 33 bp, Artificial Sequence; identical to SEQ ID NO: 66497
  Description of Artificial Sequence: Synthetic oligonucleotide

SEQ ID NO: 412122 - DNA, 35 bp, Artificial Sequence; identical to SEQ ID NO: 66498
  Description of Artificial Sequence: Synthetic oligonucleotide

SEQ ID NO: 412123 - DNA, 36 bp, Artificial Sequence; identical to SEQ ID NO: 66499
  Description of Artificial Sequence: Synthetic oligonucleotide

SEQ ID NO: 412124 - DNA, 35 bp, Artificial Sequence; identical to SEQ ID NO: 66500
  Description of Artificial Sequence: Synthetic oligonucleotide

SEQ ID NO: 412125 - DNA, 36 bp, Artificial Sequence; identical to SEQ ID NO: 66501
  Description of Artificial Sequence: Synthetic oligonucleotide

SEQ ID NO: 412126 - DNA, 35 bp, Artificial Sequence; identical to SEQ ID NO: 66502
  Description of Artificial Sequence: Synthetic oligonucleotide

SEQ ID NO: 412127 - DNA, 35 bp, Artificial Sequence; identical to SEQ ID NO: 66503
  Description of Artificial Sequence: Synthetic oligonucleotide

SEQ ID NO: 412128 - DNA, 34 bp, Artificial Sequence; identical to SEQ ID NO: 66504
  Description of Artificial Sequence: Synthetic oligonucleotide

SEQ ID NO: 412129 - DNA, 35 bp, Artificial Sequence; identical to SEQ ID NO: 66505
  Description of Artificial Sequence: Synthetic oligonucleotide

SEQ ID NO: 412130 - DNA, 34 bp, Artificial Sequence; identical to SEQ ID NO: 66506
  Description of Artificial Sequence: Synthetic oligonucleotide

SEQ ID NO: 412131 - DNA, 27 bp, Artificial Sequence
  Description of Artificial Sequence: Synthetic oligonucleotide
ggttccggaacggccaggaagagaaga

SEQ ID NO: 412132 - DNA, 27 bp, Artificial Sequence
  Description of Artificial Sequence: Synthetic oligonucleotide
gttccggaacggccaggaagagaagac

SEQ ID NO: 412133 - DNA, 28 bp, Artificial Sequence
  Description of Artificial Sequence: Synthetic oligonucleotide
ttccggaacggccaggaagagaagactg

SEQ ID NO: 412134 - DNA, 27 bp, Artificial Sequence
  Description of Artificial Sequence: Synthetic oligonucleotide
tccggaacggccaggaagagaagactg

SEQ ID NO: 412135 - DNA, 26 bp, Artificial Sequence
  Description of Artificial Sequence: Synthetic oligonucleotide
ccggaacggccaggaagagaagactg

SEQ ID NO: 412136 - DNA, 26 bp, Artificial Sequence
  Description of Artificial Sequence: Synthetic oligonucleotide
cggaacggccaggaagagaagactgg

SEQ ID NO: 412137 - DNA, 26 bp, Artificial Sequence
  Description of Artificial Sequence: Synthetic oligonucleotide
ggaacggccaggaagagaagactggg

SEQ ID NO: 412138 - DNA, 27 bp, Artificial Sequence
  Description of Artificial Sequence: Synthetic oligonucleotide
gaacggccaggaagagaagactggggt

SEQ ID NO: 412139 - DNA, 27 bp, Artificial Sequence
  Description of Artificial Sequence: Synthetic oligonucleotide
aacggccaggaagagaagactggggtg

SEQ ID NO: 412140 - DNA, 26 bp, Artificial Sequence
  Description of Artificial Sequence: Synthetic oligonucleotide
acggccaggaagagaagactggggtg

SEQ ID NO: 412141 - DNA, 25 bp, Artificial Sequence
  Description of Artificial Sequence: Synthetic oligonucleotide
cggccaggaagagaagactggggtg

SEQ ID NO: 412142 - DNA, 29 bp, Artificial Sequence
  Description of Artificial Sequence: Synthetic oligonucleotide
tgtccacaggcctgatccagaatggagac

SEQ ID NO: 412143 - DNA, 28 bp, Artificial Sequence
  Description of Artificial Sequence: Synthetic oligonucleotide
gtccacaggcctgatccagaatggagac

SEQ ID NO: 412144 - DNA, 29 bp, Artificial Sequence
  Description of Artificial Sequence: Synthetic oligonucleotide
tccacaggcctgatccagaatggagactg

SEQ ID NO: 412145 - DNA, 28 bp, Artificial Sequence
  Description of Artificial Sequence: Synthetic oligonucleotide
ccacaggcctgatccagaatggagactg

SEQ ID NO: 412146 - DNA, 28 bp, Artificial Sequence
  Description of Artificial Sequence: Synthetic oligonucleotide
cacaggcctgatccagaatggagactgg

SEQ ID NO: 412147 - DNA, 29 bp, Artificial Sequence
  Description of Artificial Sequence: Synthetic oligonucleotide
acaggcctgatccagaatggagactggac

SEQ ID NO: 412148 - DNA, 28 bp, Artificial Sequence
  Description of Artificial Sequence: Synthetic oligonucleotide
caggcctgatccagaatggagactggac

SEQ ID NO: 412149 - DNA, 28 bp, Artificial Sequence
  Description of Artificial Sequence: Synthetic oligonucleotide
aggcctgatccagaatggagactggacc

SEQ ID NO: 412150 - DNA, 27 bp, Artificial Sequence
  Description of Artificial Sequence: Synthetic oligonucleotide
ggcctgatccagaatggagactggacc

SEQ ID NO: 412151 - DNA, 29 bp, Artificial Sequence
  Description of Artificial Sequence: Synthetic oligonucleotide
gcctgatccagaatggagactggaccttc

SEQ ID NO: 412152 - DNA, 29 bp, Artificial Sequence
  Description of Artificial Sequence: Synthetic oligonucleotide
cctgatccagaatggagactggaccttcc

SEQ ID NO: 412153 - DNA, 30 bp, Artificial Sequence; identical to SEQ ID NO: 66529
  Description of Artificial Sequence: Synthetic oligonucleotide

SEQ ID NO: 412154 - DNA, 31 bp, Artificial Sequence; identical to SEQ ID NO: 66530
  Description of Artificial Sequence: Synthetic oligonucleotide

SEQ ID NO: 412155 - DNA, 30 bp, Artificial Sequence; identical to SEQ ID NO: 66531
  Description of Artificial Sequence: Synthetic oligonucleotide

SEQ ID NO: 412156 - DNA, 30 bp, Artificial Sequence; identical to SEQ ID NO: 66532
  Description of Artificial Sequence: Synthetic oligonucleotide

SEQ ID NO: 412157 - DNA, 29 bp, Artificial Sequence
  Description of Artificial Sequence: Synthetic oligonucleotide
tccagaatggagactggaccttccagacc

SEQ ID NO: 412158 - DNA, 28 bp, Artificial Sequence
  Description of Artificial Sequence: Synthetic oligonucleotide
ccagaatggagactggaccttccagacc

SEQ ID NO: 412159 - DNA, 28 bp, Artificial Sequence
  Description of Artificial Sequence: Synthetic oligonucleotide
cagaatggagactggaccttccagaccc

SEQ ID NO: 412160 - DNA, 29 bp, Artificial Sequence
  Description of Artificial Sequence: Synthetic oligonucleotide
agaatggagactggaccttccagaccctg

SEQ ID NO: 412161 - DNA, 28 bp, Artificial Sequence
  Description of Artificial Sequence: Synthetic oligonucleotide
gaatggagactggaccttccagaccctg

SEQ ID NO: 412162 - DNA, 26 bp, Artificial Sequence
  Description of Artificial Sequence: Synthetic oligonucleotide
acctgccaagtggagcacccaagcct

SEQ ID NO: 412163 - DNA, 25 bp, Artificial Sequence
  Description of Artificial Sequence: Synthetic oligonucleotide
cctgccaagtggagcacccaagcct

SEQ ID NO: 412164 - DNA, 26 bp, Artificial Sequence
  Description of Artificial Sequence: Synthetic oligonucleotide
ctgccaagtggagcacccaagcctga

SEQ ID NO: 412165 - DNA, 26 bp, Artificial Sequence
  Description of Artificial Sequence: Synthetic oligonucleotide
tgccaagtggagcacccaagcctgac

SEQ ID NO: 412166 - DNA, 25 bp, Artificial Sequence
  Description of Artificial Sequence: Synthetic oligonucleotide
gccaagtggagcacccaagcctgac

SEQ ID NO: 412167 - DNA, 26 bp, Artificial Sequence
  Description of Artificial Sequence: Synthetic oligonucleotide
ccaagtggagcacccaagcctgacga

SEQ ID NO: 412168 - DNA, 26 bp, Artificial Sequence
  Description of Artificial Sequence: Synthetic oligonucleotide
caagtggagcacccaagcctgacgag

SEQ ID NO: 412169 - DNA, 26 bp, Artificial Sequence
  Description of Artificial Sequence: Synthetic oligonucleotide
aagtggagcacccaagcctgacgagc

SEQ ID NO: 412170 - DNA, 25 bp, Artificial Sequence
  Description of Artificial Sequence: Synthetic oligonucleotide
agtggagcacccaagcctgacgagc

SEQ ID NO: 412171 - DNA, 24 bp, Artificial Sequence
  Description of Artificial Sequence: Synthetic oligonucleotide
gtggagcacccaagcctgacgagc

SEQ ID NO: 412172 - DNA, 24 bp, Artificial Sequence
  Description of Artificial Sequence: Synthetic oligonucleotide
tggagcacccaagcctgacgagcc

SEQ ID NO: 412173 - DNA, 23 bp, Artificial Sequence
  Description of Artificial Sequence: Synthetic oligonucleotide
ggagcacccaagcctgacgagcc

SEQ ID NO: 412174 - DNA, 24 bp, Artificial Sequence
  Description of Artificial Sequence: Synthetic oligonucleotide
gagcacccaagcctgacgagccct

SEQ ID NO: 412175 - DNA, 25 bp, Artificial Sequence
  Description of Artificial Sequence: Synthetic oligonucleotide
agcacccaagcctgacgagccctct

SEQ ID NO: 412176 - DNA, 24 bp, Artificial Sequence
  Description of Artificial Sequence: Synthetic oligonucleotide
gcacccaagcctgacgagccctct

SEQ ID NO: 412177 - DNA, 25 bp, Artificial Sequence
  Description of Artificial Sequence: Synthetic oligonucleotide
cacccaagcctgacgagccctctca

SEQ ID NO: 412178 - DNA, 26 bp, Artificial Sequence
  Description of Artificial Sequence: Synthetic oligonucleotide
acccaagcctgacgagccctctcaca

SEQ ID NO: 412179 - DNA, 25 bp, Artificial Sequence
  Description of Artificial Sequence: Synthetic oligonucleotide
cccaagcctgacgagccctctcaca

SEQ ID NO: 412180 - DNA, 26 bp, Artificial Sequence
  Description of Artificial Sequence: Synthetic oligonucleotide
ccaagcctgacgagccctctcacagt

SEQ ID NO: 412181 - DNA, 26 bp, Artificial Sequence
  Description of Artificial Sequence: Synthetic oligonucleotide
caagcctgacgagccctctcacagtg

SEQ ID NO: 412182 - DNA, 27 bp, Artificial Sequence
  Description of Artificial Sequence: Synthetic oligonucleotide
aagcctgacgagccctctcacagtgga

SEQ ID NO: 412183 - DNA, 27 bp, Artificial Sequence
  Description of Artificial Sequence: Synthetic oligonucleotide
agcctgacgagccctctcacagtggaa

SEQ ID NO: 412184 - DNA, 27 bp, Artificial Sequence
  Description of Artificial Sequence: Synthetic oligonucleotide
gcctgacgagccctctcacagtggaat

SEQ ID NO: 412185 - DNA, 27 bp, Artificial Sequence
  Description of Artificial Sequence: Synthetic oligonucleotide
cctgacgagccctctcacagtggaatg

SEQ ID NO: 412186 - DNA, 27 bp, Artificial Sequence
  Description of Artificial Sequence: Synthetic oligonucleotide
ctgacgagccctctcacagtggaatgg

SEQ ID NO: 412187 - DNA, 34 bp, Artificial Sequence; identical to SEQ ID NO: 66563
  Description of Artificial Sequence: Synthetic oligonucleotide

SEQ ID NO: 412188 - DNA, 35 bp, Artificial Sequence; identical to SEQ ID NO: 66564
  Description of Artificial Sequence: Synthetic oligonucleotide

SEQ ID NO: 412189 - DNA, 37 bp, Artificial Sequence; identical to SEQ ID NO: 66565
  Description of Artificial Sequence: Synthetic oligonucleotide

SEQ ID NO: 412190 - DNA, 37 bp, Artificial Sequence; identical to SEQ ID NO: 66566
  Description of Artificial Sequence: Synthetic oligonucleotide

SEQ ID NO: 412191 - DNA, 36 bp, Artificial Sequence; identical to SEQ ID NO: 66567
  Description of Artificial Sequence: Synthetic oligonucleotide

SEQ ID NO: 412192 - DNA, 35 bp, Artificial Sequence; identical to SEQ ID NO: 66568
  Description of Artificial Sequence: Synthetic oligonucleotide

SEQ ID NO: 412193 - DNA, 36 bp, Artificial Sequence; identical to SEQ ID NO: 66569
  Description of Artificial Sequence: Synthetic oligonucleotide

SEQ ID NO: 412194 - DNA, 36 bp, Artificial Sequence; identical to SEQ ID NO: 66570
  Description of Artificial Sequence: Synthetic oligonucleotide

SEQ ID NO: 412195 - DNA, 35 bp, Artificial Sequence; identical to SEQ ID NO: 66571
  Description of Artificial Sequence: Synthetic oligonucleotide

SEQ ID NO: 412196 - DNA, 35 bp, Artificial Sequence; identical to SEQ ID NO: 66572
  Description of Artificial Sequence: Synthetic oligonucleotide

SEQ ID NO: 412197 - DNA, 35 bp, Artificial Sequence; identical to SEQ ID NO: 66573
  Description of Artificial Sequence: Synthetic oligonucleotide

SEQ ID NO: 412198 - DNA, 34 bp, Artificial Sequence; identical to SEQ ID NO: 66574
  Description of Artificial Sequence: Synthetic oligonucleotide

SEQ ID NO: 412199 - DNA, 36 bp, Artificial Sequence; identical to SEQ ID NO: 66575
  Description of Artificial Sequence: Synthetic oligonucleotide

SEQ ID NO: 412200 - DNA, 35 bp, Artificial Sequence; identical to SEQ ID NO: 66576
  Description of Artificial Sequence: Synthetic oligonucleotide

SEQ ID NO: 412201 - DNA, 35 bp, Artificial Sequence; identical to SEQ ID NO: 66577
  Description of Artificial Sequence: Synthetic oligonucleotide

SEQ ID NO: 412202 - DNA, 34 bp, Artificial Sequence; identical to SEQ ID NO: 66578
  Description of Artificial Sequence: Synthetic oligonucleotide

SEQ ID NO: 412203 - DNA, 33 bp, Artificial Sequence; identical to SEQ ID NO: 66579
  Description of Artificial Sequence: Synthetic oligonucleotide

SEQ ID NO: 412204 - DNA, 32 bp, Artificial Sequence; identical to SEQ ID NO: 66580
  Description of Artificial Sequence: Synthetic oligonucleotide

SEQ ID NO: 412205 - DNA, 33 bp, Artificial Sequence; identical to SEQ ID NO: 66581
  Description of Artificial Sequence: Synthetic oligonucleotide

SEQ ID NO: 412206 - DNA, 32 bp, Artificial Sequence; identical to SEQ ID NO: 66582
  Description of Artificial Sequence: Synthetic oligonucleotide

SEQ ID NO: 412207 - DNA, 31 bp, Artificial Sequence; identical to SEQ ID NO: 66583
  Description of Artificial Sequence: Synthetic oligonucleotide

SEQ ID NO: 412208 - DNA, 32 bp, Artificial Sequence; identical to SEQ ID NO: 66584
  Description of Artificial Sequence: Synthetic oligonucleotide

SEQ ID NO: 412209 - DNA, 31 bp, Artificial Sequence; identical to SEQ ID NO: 66585
  Description of Artificial Sequence: Synthetic oligonucleotide

SEQ ID NO: 412210 - DNA, 30 bp, Artificial Sequence; identical to SEQ ID NO: 66586
  Description of Artificial Sequence: Synthetic oligonucleotide

SEQ ID NO: 412211 - DNA, 29 bp, Artificial Sequence
  Description of Artificial Sequence: Synthetic oligonucleotide
caccaagaagagtacgtgcgcttcgacag

SEQ ID NO: 412212 - DNA, 29 bp, Artificial Sequence
  Description of Artificial Sequence: Synthetic oligonucleotide
accaagaagagtacgtgcgcttcgacagc

SEQ ID NO: 412213 - DNA, 28 bp, Artificial Sequence
  Description of Artificial Sequence: Synthetic oligonucleotide
ccaagaagagtacgtgcgcttcgacagc

SEQ ID NO: 412214 - DNA, 28 bp, Artificial Sequence
  Description of Artificial Sequence: Synthetic oligonucleotide
caagaagagtacgtgcgcttcgacagcg

SEQ ID NO: 412215 - DNA, 29 bp, Artificial Sequence
  Description of Artificial Sequence: Synthetic oligonucleotide
aagaagagtacgtgcgcttcgacagcgac

SEQ ID NO: 412216 - DNA, 32 bp, Artificial Sequence; identical to SEQ ID NO: 66592
  Description of Artificial Sequence: Synthetic oligonucleotide

SEQ ID NO: 412217 - DNA, 31 bp, Artificial Sequence; identical to SEQ ID NO: 66593
  Description of Artificial Sequence: Synthetic oligonucleotide

SEQ ID NO: 412218 - DNA, 31 bp, Artificial Sequence; identical to SEQ ID NO: 66594
  Description of Artificial Sequence: Synthetic oligonucleotide

SEQ ID NO: 412219 - DNA, 32 bp, Artificial Sequence; identical to SEQ ID NO: 66595
  Description of Artificial Sequence: Synthetic oligonucleotide

SEQ ID NO: 412220 - DNA, 32 bp, Artificial Sequence; identical to SEQ ID NO: 66596
  Description of Artificial Sequence: Synthetic oligonucleotide

SEQ ID NO: 412221 - DNA, 33 bp, Artificial Sequence; identical to SEQ ID NO: 66597
  Description of Artificial Sequence: Synthetic oligonucleotide

SEQ ID NO: 412222 - DNA, 32 bp, Artificial Sequence; identical to SEQ ID NO: 66598
  Description of Artificial Sequence: Synthetic oligonucleotide

SEQ ID NO: 412223 - DNA, 31 bp, Artificial Sequence; identical to SEQ ID NO: 66599
  Description of Artificial Sequence: Synthetic oligonucleotide

SEQ ID NO: 412224 - DNA, 33 bp, Artificial Sequence; identical to SEQ ID NO: 66600
  Description of Artificial Sequence: Synthetic oligonucleotide

SEQ ID NO: 412225 - DNA, 33 bp, Artificial Sequence; identical to SEQ ID NO: 66601
  Description of Artificial Sequence: Synthetic oligonucleotide

SEQ ID NO: 412226 - DNA, 32 bp, Artificial Sequence; identical to SEQ ID NO: 66602
  Description of Artificial Sequence: Synthetic oligonucleotide

SEQ ID NO: 412227 - DNA, 33 bp, Artificial Sequence; identical to SEQ ID NO: 66603
  Description of Artificial Sequence: Synthetic oligonucleotide

SEQ ID NO: 412228 - DNA, 33 bp, Artificial Sequence; identical to SEQ ID NO: 66604
  Description of Artificial Sequence: Synthetic oligonucleotide

SEQ ID NO: 412229 - DNA, 32 bp, Artificial Sequence; identical to SEQ ID NO: 66605
  Description of Artificial Sequence: Synthetic oligonucleotide

SEQ ID NO: 412230 - DNA, 32 bp, Artificial Sequence; identical to SEQ ID NO: 66606
  Description of Artificial Sequence: Synthetic oligonucleotide

SEQ ID NO: 412231 - DNA, 31 bp, Artificial Sequence; identical to SEQ ID NO: 66607
  Description of Artificial Sequence: Synthetic oligonucleotide

SEQ ID NO: 412232 - DNA, 31 bp, Artificial Sequence; identical to SEQ ID NO: 66608
  Description of Artificial Sequence: Synthetic oligonucleotide

SEQ ID NO: 412233 - DNA, 30 bp, Artificial Sequence; identical to SEQ ID NO: 66609
  Description of Artificial Sequence: Synthetic oligonucleotide

SEQ ID NO: 412234 - DNA, 29 bp, Artificial Sequence
  Description of Artificial Sequence: Synthetic oligonucleotide
acttctatcaccaggaggagtacgtgcgc

SEQ ID NO: 412235 - DNA, 28 bp, Artificial Sequence
  Description of Artificial Sequence: Synthetic oligonucleotide
cttctatcaccaggaggagtacgtgcgc

SEQ ID NO: 412236 - DNA, 30 bp, Artificial Sequence; identical to SEQ ID NO: 66612
  Description of Artificial Sequence: Synthetic oligonucleotide

SEQ ID NO: 412237 - DNA, 29 bp, Artificial Sequence
  Description of Artificial Sequence: Synthetic oligonucleotide
tctatcaccaggaggagtacgtgcgcttc

SEQ ID NO: 412238 - DNA, 28 bp, Artificial Sequence
  Description of Artificial Sequence: Synthetic oligonucleotide
ctatcaccaggaggagtacgtgcgcttc

SEQ ID NO: 412239 - DNA, 28 bp, Artificial Sequence
  Description of Artificial Sequence: Synthetic oligonucleotide
tatcaccaggaggagtacgtgcgcttcg

SEQ ID NO: 412240 - DNA, 27 bp, Artificial Sequence
  Description of Artificial Sequence: Synthetic oligonucleotide
atcaccaggaggagtacgtgcgcttcg

SEQ ID NO: 412241 - DNA, 27 bp, Artificial Sequence
  Description of Artificial Sequence: Synthetic oligonucleotide
tcaccaggaggagtacgtgcgcttcga

SEQ ID NO: 412242 - DNA, 26 bp, Artificial Sequence
  Description of Artificial Sequence: Synthetic oligonucleotide
caccaggaggagtacgtgcgcttcga

SEQ ID NO: 412243 - DNA, 23 bp, Artificial Sequence
  Description of Artificial Sequence: Synthetic oligonucleotide
acagcgacgtgggggagtaccgc

SEQ ID NO: 412244 - DNA, 22 bp, Artificial Sequence
  Description of Artificial Sequence: Synthetic oligonucleotide
cagcgacgtgggggagtaccgc

SEQ ID NO: 412245 - DNA, 22 bp, Artificial Sequence
  Description of Artificial Sequence: Synthetic oligonucleotide
agcgacgtgggggagtaccgcg

SEQ ID NO: 412246 - DNA, 21 bp, Artificial Sequence
  Description of Artificial Sequence: Synthetic oligonucleotide
gcgacgtgggggagtaccgcg

SEQ ID NO: 412247 - DNA, 21 bp, Artificial Sequence
  Description of Artificial Sequence: Synthetic oligonucleotide
cgacgtgggggagtaccgcgc

SEQ ID NO: 412248 - DNA, 21 bp, Artificial Sequence
  Description of Artificial Sequence: Synthetic oligonucleotide
gacgtgggggagtaccgcgcg

SEQ ID NO: 412249 - DNA, 22 bp, Artificial Sequence
  Description of Artificial Sequence: Synthetic oligonucleotide
acgtgggggagtaccgcgcggt

SEQ ID NO: 412250 - DNA, 21 bp, Artificial Sequence
  Description of Artificial Sequence: Synthetic oligonucleotide
cgtgggggagtaccgcgcggt

SEQ ID NO: 412251 - DNA, 22 bp, Artificial Sequence
  Description of Artificial Sequence: Synthetic oligonucleotide
gtgggggagtaccgcgcggtga

SEQ ID NO: 412252 - DNA, 22 bp, Artificial Sequence
  Description of Artificial Sequence: Synthetic oligonucleotide
tgggggagtaccgcgcggtgac

SEQ ID NO: 412253 - DNA, 21 bp, Artificial Sequence
  Description of Artificial Sequence: Synthetic oligonucleotide
gggggagtaccgcgcggtgac

SEQ ID NO: 412254 - DNA, 21 bp, Artificial Sequence
  Description of Artificial Sequence: Synthetic oligonucleotide
ggggagtaccgcgcggtgacg

SEQ ID NO: 412255 - DNA, 22 bp, Artificial Sequence
  Description of Artificial Sequence: Synthetic oligonucleotide
gggagtaccgcgcggtgacgga

SEQ ID NO: 412256 - DNA, 22 bp, Artificial Sequence
  Description of Artificial Sequence: Synthetic oligonucleotide
ggagtaccgcgcggtgacggag

SEQ ID NO: 412257 - DNA, 23 bp, Artificial Sequence
  Description of Artificial Sequence: Synthetic oligonucleotide
gagtaccgcgcggtgacggagct

SEQ ID NO: 412258 - DNA, 23 bp, Artificial Sequence
  Description of Artificial Sequence: Synthetic oligonucleotide
agtaccgcgcggtgacggagctg

SEQ ID NO: 412259 - DNA, 22 bp, Artificial Sequence
  Description of Artificial Sequence: Synthetic oligonucleotide
gtaccgcgcggtgacggagctg

SEQ ID NO: 412260 - DNA, 22 bp, Artificial Sequence
  Description of Artificial Sequence: Synthetic oligonucleotide
taccgcgcggtgacggagctgg

SEQ ID NO: 412261 - DNA, 21 bp, Artificial Sequence
  Description of Artificial Sequence: Synthetic oligonucleotide
accgcgcggtgacggagctgg

SEQ ID NO: 412262 - DNA, 20 bp, Artificial Sequence
  Description of Artificial Sequence: Synthetic oligonucleotide
ccgcgcggtgacggagctgg

SEQ ID NO: 412263 - DNA, 20 bp, Artificial Sequence
  Description of Artificial Sequence: Synthetic oligonucleotide
cgcgcggtgacggagctggg

SEQ ID NO: 412264 - DNA, 20 bp, Artificial Sequence
  Description of Artificial Sequence: Synthetic oligonucleotide
gcgcggtgacggagctgggg

SEQ ID NO: 412265 - DNA, 20 bp, Artificial Sequence
  Description of Artificial Sequence: Synthetic oligonucleotide
cgcggtgacggagctggggc

SEQ ID NO: 412266 - DNA, 41 bp, Artificial Sequence; identical to SEQ ID NO: 66642
  Description of Artificial Sequence: Synthetic oligonucleotide

SEQ ID NO: 412267 - DNA, 43 bp, Artificial Sequence; identical to SEQ ID NO: 66643
  Description of Artificial Sequence: Synthetic oligonucleotide

SEQ ID NO: 412268 - DNA, 42 bp, Artificial Sequence; identical to SEQ ID NO: 66644
  Description of Artificial Sequence: Synthetic oligonucleotide

SEQ ID NO: 412269 - DNA, 42 bp, Artificial Sequence; identical to SEQ ID NO: 66645
  Description of Artificial Sequence: Synthetic oligonucleotide

SEQ ID NO: 412270 - DNA, 42 bp, Artificial Sequence; identical to SEQ ID NO: 66646
  Description of Artificial Sequence: Synthetic oligonucleotide

SEQ ID NO: 412271 - DNA, 41 bp, Artificial Sequence; identical to SEQ ID NO: 66647
  Description of Artificial Sequence: Synthetic oligonucleotide

SEQ ID NO: 412272 - DNA, 40 bp, Artificial Sequence; identical to SEQ ID NO: 66648
  Description of Artificial Sequence: Synthetic oligonucleotide

SEQ ID NO: 412273 - DNA, 39 bp, Artificial Sequence; identical to SEQ ID NO: 66649
  Description of Artificial Sequence: Synthetic oligonucleotide

SEQ ID NO: 412274 - DNA, 39 bp, Artificial Sequence; identical to SEQ ID NO: 66650
  Description of Artificial Sequence: Synthetic oligonucleotide

SEQ ID NO: 412275 - DNA, 38 bp, Artificial Sequence; identical to SEQ ID NO: 66651
  Description of Artificial Sequence: Synthetic oligonucleotide

SEQ ID NO: 412276 - DNA, 37 bp, Artificial Sequence; identical to SEQ ID NO: 66652
  Description of Artificial Sequence: Synthetic oligonucleotide

SEQ ID NO: 412277 - DNA, 38 bp, Artificial Sequence; identical to SEQ ID NO: 66653
  Description of Artificial Sequence: Synthetic oligonucleotide

SEQ ID NO: 412278 - DNA, 38 bp, Artificial Sequence; identical to SEQ ID NO: 66654
  Description of Artificial Sequence: Synthetic oligonucleotide

SEQ ID NO: 412279 - DNA, 37 bp, Artificial Sequence; identical to SEQ ID NO: 66655
  Description of Artificial Sequence: Synthetic oligonucleotide

SEQ ID NO: 412280 - DNA, 37 bp, Artificial Sequence; identical to SEQ ID NO: 66656
  Description of Artificial Sequence: Synthetic oligonucleotide

SEQ ID NO: 412281 - DNA, 38 bp, Artificial Sequence; identical to SEQ ID NO: 66657
  Description of Artificial Sequence: Synthetic oligonucleotide

SEQ ID NO: 412282 - DNA, 37 bp, Artificial Sequence; identical to SEQ ID NO: 66658
  Description of Artificial Sequence: Synthetic oligonucleotide

SEQ ID NO: 412283 - DNA, 37 bp, Artificial Sequence; identical to SEQ ID NO: 66659
  Description of Artificial Sequence: Synthetic oligonucleotide

SEQ ID NO: 412284 - DNA, 37 bp, Artificial Sequence; identical to SEQ ID NO: 66660
  Description of Artificial Sequence: Synthetic oligonucleotide

SEQ ID NO: 412285 - DNA, 36 bp, Artificial Sequence; identical to SEQ ID NO: 66661
  Description of Artificial Sequence: Synthetic oligonucleotide

SEQ ID NO: 412286 - DNA, 35 bp, Artificial Sequence; identical to SEQ ID NO: 66662
  Description of Artificial Sequence: Synthetic oligonucleotide

SEQ ID NO: 412287 - DNA, 34 bp, Artificial Sequence; identical to SEQ ID NO: 66663
  Description of Artificial Sequence: Synthetic oligonucleotide

SEQ ID NO: 412288 - DNA, 33 bp, Artificial Sequence; identical to SEQ ID NO: 66664
  Description of Artificial Sequence: Synthetic oligonucleotide

SEQ ID NO: 412289 - DNA, 32 bp, Artificial Sequence; identical to SEQ ID NO: 66665
  Description of Artificial Sequence: Synthetic oligonucleotide

SEQ ID NO: 412290 - DNA, 32 bp, Artificial Sequence; identical to SEQ ID NO: 66666
  Description of Artificial Sequence: Synthetic oligonucleotide

SEQ ID NO: 412291 - DNA, 37 bp, Artificial Sequence; identical to SEQ ID NO: 66667
  Description of Artificial Sequence: Synthetic oligonucleotide

SEQ ID NO: 412292 - DNA, 36 bp, Artificial Sequence; identical to SEQ ID NO: 66668
  Description of Artificial Sequence: Synthetic oligonucleotide

SEQ ID NO: 412293 - DNA, 35 bp, Artificial Sequence; identical to SEQ ID NO: 66669
  Description of Artificial Sequence: Synthetic oligonucleotide

SEQ ID NO: 412294 - DNA, 34 bp, Artificial Sequence; identical to SEQ ID NO: 66670
  Description of Artificial Sequence: Synthetic oligonucleotide

SEQ ID NO: 412295 - DNA, 33 bp, Artificial Sequence; identical to SEQ ID NO: 66671
  Description of Artificial Sequence: Synthetic oligonucleotide

SEQ ID NO: 412296 - DNA, 32 bp, Artificial Sequence; identical to SEQ ID NO: 66672
  Description of Artificial Sequence: Synthetic oligonucleotide

SEQ ID NO: 412297 - DNA, 32 bp, Artificial Sequence; identical to SEQ ID NO: 66673
  Description of Artificial Sequence: Synthetic oligonucleotide

SEQ ID NO: 412298 - DNA, 31 bp, Artificial Sequence; identical to SEQ ID NO: 66674
  Description of Artificial Sequence: Synthetic oligonucleotide

SEQ ID NO: 412299 - DNA, 30 bp, Artificial Sequence; identical to SEQ ID NO: 66675
  Description of Artificial Sequence: Synthetic oligonucleotide

SEQ ID NO: 412300 - DNA, 30 bp, Artificial Sequence; identical to SEQ ID NO: 66676
  Description of Artificial Sequence: Synthetic oligonucleotide

SEQ ID NO: 412301 - DNA, 29 bp, Artificial Sequence
  Description of Artificial Sequence: Synthetic oligonucleotide
gtgtcatttcttcaacgggacggagaggg

SEQ ID NO: 412302 - DNA, 30 bp, Artificial Sequence; identical to SEQ ID NO: 66678
  Description of Artificial Sequence: Synthetic oligonucleotide

SEQ ID NO: 412303 - DNA, 29 bp, Artificial Sequence
  Description of Artificial Sequence: Synthetic oligonucleotide
gtcatttcttcaacgggacggagagggtg

SEQ ID NO: 412304 - DNA, 29 bp, Artificial Sequence
  Description of Artificial Sequence: Synthetic oligonucleotide
tcatttcttcaacgggacggagagggtgc

SEQ ID NO: 412305 - DNA, 28 bp, Artificial Sequence
  Description of Artificial Sequence: Synthetic oligonucleotide
catttcttcaacgggacggagagggtgc

SEQ ID NO: 412306 - DNA, 28 bp, Artificial Sequence
  Description of Artificial Sequence: Synthetic oligonucleotide
atttcttcaacgggacggagagggtgcg

SEQ ID NO: 412307 - DNA, 27 bp, Artificial Sequence
  Description of Artificial Sequence: Synthetic oligonucleotide
tttcttcaacgggacggagagggtgcg

SEQ ID NO: 412308 - DNA, 26 bp, Artificial Sequence
  Description of Artificial Sequence: Synthetic oligonucleotide
ttcttcaacgggacggagagggtgcg

SEQ ID NO: 412309 - DNA, 25 bp, Artificial Sequence
  Description of Artificial Sequence: Synthetic oligonucleotide
tcttcaacgggacggagagggtgcg

SEQ ID NO: 412310 - DNA, 24 bp, Artificial Sequence
  Description of Artificial Sequence: Synthetic oligonucleotide
cttcaacgggacggagagggtgcg

SEQ ID NO: 412311 - DNA, 26 bp, Artificial Sequence
  Description of Artificial Sequence: Synthetic oligonucleotide
ttcaacgggacggagagggtgcggtt

SEQ ID NO: 412312 - DNA, 25 bp, Artificial Sequence
  Description of Artificial Sequence: Synthetic oligonucleotide
tcaacgggacggagagggtgcggtt

SEQ ID NO: 412313 - DNA, 24 bp, Artificial Sequence
  Description of Artificial Sequence: Synthetic oligonucleotide
caacgggacggagagggtgcggtt

SEQ ID NO: 412314 - DNA, 24 bp, Artificial Sequence
  Description of Artificial Sequence: Synthetic oligonucleotide
aacgggacggagagggtgcggttc

SEQ ID NO: 412315 - DNA, 23 bp, Artificial Sequence
  Description of Artificial Sequence: Synthetic oligonucleotide
acgggacggagagggtgcggttc

SEQ ID NO: 412316 - DNA, 22 bp, Artificial Sequence
  Description of Artificial Sequence: Synthetic oligonucleotide
cgggacggagagggtgcggttc

SEQ ID NO: 412317 - DNA, 23 bp, Artificial Sequence
  Description of Artificial Sequence: Synthetic oligonucleotide
gggacggagagggtgcggttcct

SEQ ID NO: 412318 - DNA, 23 bp, Artificial Sequence
  Description of Artificial Sequence: Synthetic oligonucleotide
ggacggagagggtgcggttcctg

SEQ ID NO: 412319 - DNA, 24 bp, Artificial Sequence
  Description of Artificial Sequence: Synthetic oligonucleotide
gacggagagggtgcggttcctgga

SEQ ID NO: 412320 - DNA, 25 bp, Artificial Sequence
  Description of Artificial Sequence: Synthetic oligonucleotide
acggagagggtgcggttcctggaca

SEQ ID NO: 412321 - DNA, 24 bp, Artificial Sequence
  Description of Artificial Sequence: Synthetic oligonucleotide
cggagagggtgcggttcctggaca

SEQ ID NO: 412322 - DNA, 27 bp, Artificial Sequence
  Description of Artificial Sequence: Synthetic oligonucleotide
ggagagggtgcggttcctggacagata

SEQ ID NO: 412323 - DNA, 27 bp, Artificial Sequence
  Description of Artificial Sequence: Synthetic oligonucleotide
gagagggtgcggttcctggacagatac

SEQ ID NO: 412324 - DNA, 29 bp, Artificial Sequence
  Description of Artificial Sequence: Synthetic oligonucleotide
agagggtgcggttcctggacagatacttc

SEQ ID NO: 412325 - DNA, 28 bp, Artificial Sequence
  Description of Artificial Sequence: Synthetic oligonucleotide
gagggtgcggttcctggacagatacttc

SEQ ID NO: 412326 - DNA, 31 bp, Artificial Sequence; identical to SEQ ID NO: 66702
  Description of Artificial Sequence: Synthetic oligonucleotide

SEQ ID NO: 412327 - DNA, 26 bp, Artificial Sequence
  Description of Artificial Sequence: Synthetic oligonucleotide
gcttcgacagcgacgtgggggagtat

SEQ ID NO: 412328 - DNA, 26 bp, Artificial Sequence
  Description of Artificial Sequence: Synthetic oligonucleotide
cttcgacagcgacgtgggggagtatc

SEQ ID NO: 412329 - DNA, 26 bp, Artificial Sequence
  Description of Artificial Sequence: Synthetic oligonucleotide
ttcgacagcgacgtgggggagtatcg

SEQ ID NO: 412330 - DNA, 25 bp, Artificial Sequence
  Description of Artificial Sequence: Synthetic oligonucleotide
tcgacagcgacgtgggggagtatcg

SEQ ID NO: 412331 - DNA, 24 bp, Artificial Sequence
  Description of Artificial Sequence: Synthetic oligonucleotide
cgacagcgacgtgggggagtatcg

SEQ ID NO: 412332 - DNA, 24 bp, Artificial Sequence
  Description of Artificial Sequence: Synthetic oligonucleotide
gacagcgacgtgggggagtatcgg

SEQ ID NO: 412333 - DNA, 24 bp, Artificial Sequence
  Description of Artificial Sequence: Synthetic oligonucleotide
acagcgacgtgggggagtatcggg

SEQ ID NO: 412334 - DNA, 23 bp, Artificial Sequence
  Description of Artificial Sequence: Synthetic oligonucleotide
cagcgacgtgggggagtatcggg

SEQ ID NO: 412335 - DNA, 23 bp, Artificial Sequence
  Description of Artificial Sequence: Synthetic oligonucleotide
agcgacgtgggggagtatcgggc

SEQ ID NO: 412336 - DNA, 22 bp, Artificial Sequence
  Description of Artificial Sequence: Synthetic oligonucleotide
gcgacgtgggggagtatcgggc

SEQ ID NO: 412337 - DNA, 22 bp, Artificial Sequence
  Description of Artificial Sequence: Synthetic oligonucleotide
cgacgtgggggagtatcgggcg

SEQ ID NO: 412338 - DNA, 23 bp, Artificial Sequence
  Description of Artificial Sequence: Synthetic oligonucleotide
gacgtgggggagtatcgggcggt

SEQ ID NO: 412339 - DNA, 24 bp, Artificial Sequence
  Description of Artificial Sequence: Synthetic oligonucleotide
acgtgggggagtatcgggcggtga

SEQ ID NO: 412340 - DNA, 23 bp, Artificial Sequence
  Description of Artificial Sequence: Synthetic oligonucleotide
cgtgggggagtatcgggcggtga

SEQ ID NO: 412341 - DNA, 23 bp, Artificial Sequence
  Description of Artificial Sequence: Synthetic oligonucleotide
gtgggggagtatcgggcggtgac

SEQ ID NO: 412342 - DNA, 23 bp, Artificial Sequence
  Description of Artificial Sequence: Synthetic oligonucleotide
tgggggagtatcgggcggtgacg

SEQ ID NO: 412343 - DNA, 22 bp, Artificial Sequence
  Description of Artificial Sequence: Synthetic oligonucleotide
gggggagtatcgggcggtgacg

SEQ ID NO: 412344 - DNA, 23 bp, Artificial Sequence
  Description of Artificial Sequence: Synthetic oligonucleotide
ggggagtatcgggcggtgacgga

SEQ ID NO: 412345 - DNA, 23 bp, Artificial Sequence
  Description of Artificial Sequence: Synthetic oligonucleotide
gggagtatcgggcggtgacggag

SEQ ID NO: 412346 - DNA, 24 bp, Artificial Sequence
  Description of Artificial Sequence: Synthetic oligonucleotide
ggagtatcgggcggtgacggagct

SEQ ID NO: 412347 - DNA, 24 bp, Artificial Sequence
  Description of Artificial Sequence: Synthetic oligonucleotide
gagtatcgggcggtgacggagctg

SEQ ID NO: 412348 - DNA, 24 bp, Artificial Sequence
  Description of Artificial Sequence: Synthetic oligonucleotide
agtatcgggcggtgacggagctgg

SEQ ID NO: 412349 - DNA, 23 bp, Artificial Sequence
  Description of Artificial Sequence: Synthetic oligonucleotide
gtatcgggcggtgacggagctgg

SEQ ID NO: 412350 - DNA, 23 bp, Artificial Sequence
  Description of Artificial Sequence: Synthetic oligonucleotide
tatcgggcggtgacggagctggg

SEQ ID NO: 412351 - DNA, 22 bp, Artificial Sequence
  Description of Artificial Sequence: Synthetic oligonucleotide
atcgggcggtgacggagctggg

SEQ ID NO: 412352 - DNA, 21 bp, Artificial Sequence
  Description of Artificial Sequence: Synthetic oligonucleotide
tcgggcggtgacggagctggg

SEQ ID NO: 412353 - DNA, 42 bp, Artificial Sequence; identical to SEQ ID NO: 70318
  Description of Artificial Sequence: Synthetic oligonucleotide

SEQ ID NO: 412354 - DNA, 42 bp, Artificial Sequence; identical to SEQ ID NO: 70319
  Description of Artificial Sequence: Synthetic oligonucleotide

SEQ ID NO: 412355 - DNA, 41 bp, Artificial Sequence; identical to SEQ ID NO: 70320
  Description of Artificial Sequence: Synthetic oligonucleotide

SEQ ID NO: 412356 - DNA, 40 bp, Artificial Sequence; identical to SEQ ID NO: 70321
  Description of Artificial Sequence: Synthetic oligonucleotide

SEQ ID NO: 412357 - DNA, 39 bp, Artificial Sequence; identical to SEQ ID NO: 70322
  Description of Artificial Sequence: Synthetic oligonucleotide

SEQ ID NO: 412358 - DNA, 39 bp, Artificial Sequence; identical to SEQ ID NO: 70323
  Description of Artificial Sequence: Synthetic oligonucleotide

SEQ ID NO: 412359 - DNA, 38 bp, Artificial Sequence; identical to SEQ ID NO: 70324
  Description of Artificial Sequence: Synthetic oligonucleotide

SEQ ID NO: 412360 - DNA, 37 bp, Artificial Sequence; identical to SEQ ID NO: 70325
  Description of Artificial Sequence: Synthetic oligonucleotide

SEQ ID NO: 412361 - DNA, 38 bp, Artificial Sequence; identical to SEQ ID NO: 70326
  Description of Artificial Sequence: Synthetic oligonucleotide

SEQ ID NO: 412362 - DNA, 38 bp, Artificial Sequence; identical to SEQ ID NO: 70327
  Description of Artificial Sequence: Synthetic oligonucleotide

SEQ ID NO: 412363 - DNA, 37 bp, Artificial Sequence; identical to SEQ ID NO: 70328
  Description of Artificial Sequence: Synthetic oligonucleotide

SEQ ID NO: 412364 - DNA, 37 bp, Artificial Sequence; identical to SEQ ID NO: 70329
  Description of Artificial Sequence: Synthetic oligonucleotide

SEQ ID NO: 412365 - DNA, 38 bp, Artificial Sequence; identical to SEQ ID NO: 70330
  Description of Artificial Sequence: Synthetic oligonucleotide

SEQ ID NO: 412366 - DNA, 37 bp, Artificial Sequence; identical to SEQ ID NO: 70331
  Description of Artificial Sequence: Synthetic oligonucleotide

SEQ ID NO: 412367 - DNA, 37 bp, Artificial Sequence; identical to SEQ ID NO: 70332
  Description of Artificial Sequence: Synthetic oligonucleotide

SEQ ID NO: 412368 - DNA, 37 bp, Artificial Sequence; identical to SEQ ID NO: 70333
  Description of Artificial Sequence: Synthetic oligonucleotide

SEQ ID NO: 412369 - DNA, 36 bp, Artificial Sequence; identical to SEQ ID NO: 70334
  Description of Artificial Sequence: Synthetic oligonucleotide

SEQ ID NO: 412370 - DNA, 35 bp, Artificial Sequence; identical to SEQ ID NO: 70335
  Description of Artificial Sequence: Synthetic oligonucleotide

SEQ ID NO: 412371 - DNA, 34 bp, Artificial Sequence; identical to SEQ ID NO: 70336
  Description of Artificial Sequence: Synthetic oligonucleotide

SEQ ID NO: 412372 - DNA, 33 bp, Artificial Sequence; identical to SEQ ID NO: 70337
  Description of Artificial Sequence: Synthetic oligonucleotide

SEQ ID NO: 412373 - DNA, 32 bp, Artificial Sequence; identical to SEQ ID NO: 70338
  Description of Artificial Sequence: Synthetic oligonucleotide

SEQ ID NO: 412374 - DNA, 32 bp, Artificial Sequence; identical to SEQ ID NO: 70339
  Description of Artificial Sequence: Synthetic oligonucleotide

SEQ ID NO: 412375 - DNA, 22 bp, Artificial Sequence
  Description of Artificial Sequence: Synthetic oligonucleotide
cgacgtgggggagtaccgggca

SEQ ID NO: 412376 - DNA, 23 bp, Artificial Sequence
  Description of Artificial Sequence: Synthetic oligonucleotide
gacgtgggggagtaccgggcagt

SEQ ID NO: 412377 - DNA, 24 bp, Artificial Sequence
  Description of Artificial Sequence: Synthetic oligonucleotide
acgtgggggagtaccgggcagtga

SEQ ID NO: 412378 - DNA, 23 bp, Artificial Sequence
  Description of Artificial Sequence: Synthetic oligonucleotide
cgtgggggagtaccgggcagtga

SEQ ID NO: 412379 - DNA, 23 bp, Artificial Sequence
  Description of Artificial Sequence: Synthetic oligonucleotide
gtgggggagtaccgggcagtgac

SEQ ID NO: 412380 - DNA, 23 bp, Artificial Sequence
  Description of Artificial Sequence: Synthetic oligonucleotide
tgggggagtaccgggcagtgacg

SEQ ID NO: 412381 - DNA, 22 bp, Artificial Sequence
  Description of Artificial Sequence: Synthetic oligonucleotide
gggggagtaccgggcagtgacg

SEQ ID NO: 412382 - DNA, 23 bp, Artificial Sequence
  Description of Artificial Sequence: Synthetic oligonucleotide
ggggagtaccgggcagtgacgga

SEQ ID NO: 412383 - DNA, 23 bp, Artificial Sequence
  Description of Artificial Sequence: Synthetic oligonucleotide
gggagtaccgggcagtgacggag

SEQ ID NO: 412384 - DNA, 24 bp, Artificial Sequence
  Description of Artificial Sequence: Synthetic oligonucleotide
ggagtaccgggcagtgacggagct

SEQ ID NO: 412385 - DNA, 24 bp, Artificial Sequence
  Description of Artificial Sequence: Synthetic oligonucleotide
gagtaccgggcagtgacggagctg

SEQ ID NO: 412386 - DNA, 24 bp, Artificial Sequence
  Description of Artificial Sequence: Synthetic oligonucleotide
agtaccgggcagtgacggagctgg

SEQ ID NO: 412387 - DNA, 23 bp, Artificial Sequence
  Description of Artificial Sequence: Synthetic oligonucleotide
gtaccgggcagtgacggagctgg

SEQ ID NO: 412388 - DNA, 23 bp, Artificial Sequence
  Description of Artificial Sequence: Synthetic oligonucleotide
taccgggcagtgacggagctggg

SEQ ID NO: 412389 - DNA, 22 bp, Artificial Sequence
  Description of Artificial Sequence: Synthetic oligonucleotide
accgggcagtgacggagctggg

SEQ ID NO: 412390 - DNA, 21 bp, Artificial Sequence
  Description of Artificial Sequence: Synthetic oligonucleotide
ccgggcagtgacggagctggg

SEQ ID NO: 412391 - DNA, 21 bp, Artificial Sequence
  Description of Artificial Sequence: Synthetic oligonucleotide
cgggcagtgacggagctgggg

SEQ ID NO: 412392 - DNA, 21 bp, Artificial Sequence
  Description of Artificial Sequence: Synthetic oligonucleotide
gggcagtgacggagctggggc

SEQ ID NO: 412393 - DNA, 21 bp, Artificial Sequence
  Description of Artificial Sequence: Synthetic oligonucleotide
ggcagtgacggagctggggcg

SEQ ID NO: 412394 - DNA, 21 bp, Artificial Sequence
  Description of Artificial Sequence: Synthetic oligonucleotide
gcagtgacggagctggggcgg

SEQ ID NO: 412395 - DNA, 21 bp, Artificial Sequence
  Description of Artificial Sequence: Synthetic oligonucleotide
cagtgacggagctggggcggc

SEQ ID NO: 412396 - DNA, 22 bp, Artificial Sequence
  Description of Artificial Sequence: Synthetic oligonucleotide
agtgacggagctggggcggcct

SEQ ID NO: 412397 - DNA, 39 bp, Artificial Sequence
  Description of Artificial Sequence: Synthetic oligonucleotide
gcatccacagaatcacagcattttccagtattgaaagac

SEQ ID NO: 412398 - DNA, 39 bp, Artificial Sequence
  Description of Artificial Sequence: Synthetic oligonucleotide
catccacagaatcacagcattttccagtattgaaagacc

SEQ ID NO: 412399 - DNA, 40 bp, Artificial Sequence
  Description of Artificial Sequence: Synthetic oligonucleotide
atccacagaatcacagcattttccagtattgaaagacctg

SEQ ID NO: 412400 - DNA, 39 bp, Artificial Sequence
  Description of Artificial Sequence: Synthetic oligonucleotide
tccacagaatcacagcattttccagtattgaaagacctg

SEQ ID NO: 412401 - DNA, 38 bp, Artificial Sequence
  Description of Artificial Sequence: Synthetic oligonucleotide
ccacagaatcacagcattttccagtattgaaagacctg

SEQ ID NO: 412402 - DNA, 41 bp, Artificial Sequence
  Description of Artificial Sequence: Synthetic oligonucleotide
cacagaatcacagcattttccagtattgaaagacctgaaag

SEQ ID NO: 412403 - DNA, 43 bp, Artificial Sequence
  Description of Artificial Sequence: Synthetic oligonucleotide
acagaatcacagcattttccagtattgaaagacctgaaagatc

SEQ ID NO: 412404 - DNA, 42 bp, Artificial Sequence
  Description of Artificial Sequence: Synthetic oligonucleotide
cagaatcacagcattttccagtattgaaagacctgaaagatc

SEQ ID NO: 412405 - DNA, 43 bp, Artificial Sequence
  Description of Artificial Sequence: Synthetic oligonucleotide
agaatcacagcattttccagtattgaaagacctgaaagatcac

SEQ ID NO: 412406 - DNA, 42 bp, Artificial Sequence
  Description of Artificial Sequence: Synthetic oligonucleotide
gaatcacagcattttccagtattgaaagacctgaaagatcac

SEQ ID NO: 412407 - DNA, 42 bp, Artificial Sequence
  Description of Artificial Sequence: Synthetic oligonucleotide
aatcacagcattttccagtattgaaagacctgaaagatcacg

SEQ ID NO: 412408 - DNA, 41 bp, Artificial Sequence
  Description of Artificial Sequence: Synthetic oligonucleotide
atcacagcattttccagtattgaaagacctgaaagatcacg

SEQ ID NO: 412409 - DNA, 40 bp, Artificial Sequence
  Description of Artificial Sequence: Synthetic oligonucleotide
tcacagcattttccagtattgaaagacctgaaagatcacg

SEQ ID NO: 412410 - DNA, 39 bp, Artificial Sequence
  Description of Artificial Sequence: Synthetic oligonucleotide
cacagcattttccagtattgaaagacctgaaagatcacg

SEQ ID NO: 412411 - DNA, 39 bp, Artificial Sequence
  Description of Artificial Sequence: Synthetic oligonucleotide
acagcattttccagtattgaaagacctgaaagatcacgg

SEQ ID NO: 412412 - DNA, 38 bp, Artificial Sequence
  Description of Artificial Sequence: Synthetic oligonucleotide
cagcattttccagtattgaaagacctgaaagatcacgg

SEQ ID NO: 412413 - DNA, 39 bp, Artificial Sequence
  Description of Artificial Sequence: Synthetic oligonucleotide
agcattttccagtattgaaagacctgaaagatcacggtg

SEQ ID NO: 412414 - DNA, 38 bp, Artificial Sequence
  Description of Artificial Sequence: Synthetic oligonucleotide
gcattttccagtattgaaagacctgaaagatcacggtg

SEQ ID NO: 412415 - DNA, 42 bp, Artificial Sequence
  Description of Artificial Sequence: Synthetic oligonucleotide
agtattgaaagacctgaaagatcacggtgccttcattttaac

SEQ ID NO: 412416 - DNA, 41 bp, Artificial Sequence
  Description of Artificial Sequence: Synthetic oligonucleotide
gtattgaaagacctgaaagatcacggtgccttcattttaac

SEQ ID NO: 412417 - DNA, 42 bp, Artificial Sequence
  Description of Artificial Sequence: Synthetic oligonucleotide
tattgaaagacctgaaagatcacggtgccttcattttaactg

SEQ ID NO: 412418 - DNA, 41 bp, Artificial Sequence
  Description of Artificial Sequence: Synthetic oligonucleotide
attgaaagacctgaaagatcacggtgccttcattttaactg

SEQ ID NO: 412419 - DNA, 40 bp, Artificial Sequence
  Description of Artificial Sequence: Synthetic oligonucleotide
ttgaaagacctgaaagatcacggtgccttcattttaactg

SEQ ID NO: 412420 - DNA, 39 bp, Artificial Sequence
  Description of Artificial Sequence: Synthetic oligonucleotide
tgaaagacctgaaagatcacggtgccttcattttaactg

SEQ ID NO: 412421 - DNA, 38 bp, Artificial Sequence
  Description of Artificial Sequence: Synthetic oligonucleotide
gaaagacctgaaagatcacggtgccttcattttaactg

SEQ ID NO: 412422 - DNA, 39 bp, Artificial Sequence
  Description of Artificial Sequence: Synthetic oligonucleotide
aaagacctgaaagatcacggtgccttcattttaactgtg

SEQ ID NO: 412423 - DNA, 38 bp, Artificial Sequence
  Description of Artificial Sequence: Synthetic oligonucleotide
aagacctgaaagatcacggtgccttcattttaactgtg

SEQ ID NO: 412424 - DNA, 37 bp, Artificial Sequence
  Description of Artificial Sequence: Synthetic oligonucleotide
agacctgaaagatcacggtgccttcattttaactgtg

SEQ ID NO: 412425 - DNA, 36 bp, Artificial Sequence
  Description of Artificial Sequence: Synthetic oligonucleotide
gacctgaaagatcacggtgccttcattttaactgtg

SEQ ID NO: 412426 - DNA, 37 bp, Artificial Sequence
  Description of Artificial Sequence: Synthetic oligonucleotide
acctgaaagatcacggtgccttcattttaactgtgag

SEQ ID NO: 412427 - DNA, 36 bp, Artificial Sequence
  Description of Artificial Sequence: Synthetic oligonucleotide
cctgaaagatcacggtgccttcattttaactgtgag

SEQ ID NO: 412428 - DNA, 37 bp, Artificial Sequence
  Description of Artificial Sequence: Synthetic oligonucleotide
ctgaaagatcacggtgccttcattttaactgtgagac

SEQ ID NO: 412429 - DNA, 39 bp, Artificial Sequence
  Description of Artificial Sequence: Synthetic oligonucleotide
tgaaagatcacggtgccttcattttaactgtgagacatg

SEQ ID NO: 412430 - DNA, 38 bp, Artificial Sequence
  Description of Artificial Sequence: Synthetic oligonucleotide
gaaagatcacggtgccttcattttaactgtgagacatg

SEQ ID NO: 412431 - DNA, 40 bp, Artificial Sequence
  Description of Artificial Sequence: Synthetic oligonucleotide
aaagatcacggtgccttcattttaactgtgagacatgaag

SEQ ID NO: 412432 - DNA, 39 bp, Artificial Sequence
  Description of Artificial Sequence: Synthetic oligonucleotide
aagatcacggtgccttcattttaactgtgagacatgaag

SEQ ID NO: 412433 - DNA, 38 bp, Artificial Sequence
  Description of Artificial Sequence: Synthetic oligonucleotide
agatcacggtgccttcattttaactgtgagacatgaag

SEQ ID NO: 412434 - DNA, 37 bp, Artificial Sequence
  Description of Artificial Sequence: Synthetic oligonucleotide
gatcacggtgccttcattttaactgtgagacatgaag

SEQ ID NO: 412435 - DNA, 44 bp, Artificial Sequence
  Description of Artificial Sequence: Synthetic oligonucleotide
atcacggtgccttcattttaactgtgagacatgaagtaattttc

SEQ ID NO: 412436 - DNA, 43 bp, Artificial Sequence
  Description of Artificial Sequence: Synthetic oligonucleotide
tcacggtgccttcattttaactgtgagacatgaagtaattttc

SEQ ID NO: 412437 - DNA, 42 bp, Artificial Sequence
  Description of Artificial Sequence: Synthetic oligonucleotide
cacggtgccttcattttaactgtgagacatgaagtaattttc

SEQ ID NO: 412438 - DNA, 42 bp, Artificial Sequence
  Description of Artificial Sequence: Synthetic oligonucleotide
acggtgccttcattttaactgtgagacatgaagtaattttcc

SEQ ID NO: 412439 - DNA, 41 bp, Artificial Sequence
  Description of Artificial Sequence: Synthetic oligonucleotide
cggtgccttcattttaactgtgagacatgaagtaattttcc

SEQ ID NO: 412440 - DNA, 41 bp, Artificial Sequence
  Description of Artificial Sequence: Synthetic oligonucleotide
ggtgccttcattttaactgtgagacatgaagtaattttccc

SEQ ID NO: 412441 - DNA, 43 bp, Artificial Sequence
  Description of Artificial Sequence: Synthetic oligonucleotide
gtgccttcattttaactgtgagacatgaagtaattttcccaag

SEQ ID NO: 412442 - DNA, 44 bp, Artificial Sequence
  Description of Artificial Sequence: Synthetic oligonucleotide
tgccttcattttaactgtgagacatgaagtaattttcccaagtc

SEQ ID NO: 412443 - DNA, 43 bp, Artificial Sequence
  Description of Artificial Sequence: Synthetic oligonucleotide
gccttcattttaactgtgagacatgaagtaattttcccaagtc

SEQ ID NO: 412444 - DNA, 45 bp, Artificial Sequence
  Description of Artificial Sequence: Synthetic oligonucleotide
ccttcattttaactgtgagacatgaagtaattttcccaagtctac

SEQ ID NO: 412445 - DNA, 47 bp, Artificial Sequence
  Description of Artificial Sequence: Synthetic oligonucleotide
cttcattttaactgtgagacatgaagtaattttcccaagtctacaac

SEQ ID NO: 412446 - DNA, 48 bp, Artificial Sequence
  Description of Artificial Sequence: Synthetic oligonucleotide
ttcattttaactgtgagacatgaagtaattttcccaagtctacaacag

SEQ ID NO: 412447 - DNA, 47 bp, Artificial Sequence
  Description of Artificial Sequence: Synthetic oligonucleotide
tcattttaactgtgagacatgaagtaattttcccaagtctacaacag

SEQ ID NO: 412448 - DNA, 46 bp, Artificial Sequence
  Description of Artificial Sequence: Synthetic oligonucleotide
cattttaactgtgagacatgaagtaattttcccaagtctacaacag

SEQ ID NO: 412449 - DNA, 49 bp, Artificial Sequence
  Description of Artificial Sequence: Synthetic oligonucleotide
attttaactgtgagacatgaagtaattttcccaagtctacaacagtaag

SEQ ID NO: 412450 - DNA, 48 bp, Artificial Sequence
  Description of Artificial Sequence: Synthetic oligonucleotide
ttttaactgtgagacatgaagtaattttcccaagtctacaacagtaag

SEQ ID NO: 412451 - DNA, 47 bp, Artificial Sequence
  Description of Artificial Sequence: Synthetic oligonucleotide
tttaactgtgagacatgaagtaattttcccaagtctacaacagtaag

SEQ ID NO: 412452 - DNA, 46 bp, Artificial Sequence
  Description of Artificial Sequence: Synthetic oligonucleotide
ttaactgtgagacatgaagtaattttcccaagtctacaacagtaag

SEQ ID NO: 412453 - DNA, 45 bp, Artificial Sequence
  Description of Artificial Sequence: Synthetic oligonucleotide
taactgtgagacatgaagtaattttcccaagtctacaacagtaag

SEQ ID NO: 412454 - DNA, 44 bp, Artificial Sequence
  Description of Artificial Sequence: Synthetic oligonucleotide
aactgtgagacatgaagtaattttcccaagtctacaacagtaag

SEQ ID NO: 412455 - DNA, 43 bp, Artificial Sequence
  Description of Artificial Sequence: Synthetic oligonucleotide
actgtgagacatgaagtaattttcccaagtctacaacagtaag

SEQ ID NO: 412456 - DNA, 42 bp, Artificial Sequence
  Description of Artificial Sequence: Synthetic oligonucleotide
ctgtgagacatgaagtaattttcccaagtctacaacagtaag

SEQ ID NO: 412457 - DNA, 46 bp, Artificial Sequence
  Description of Artificial Sequence: Synthetic oligonucleotide
tgtgagacatgaagtaattttcccaagtctacaacagtaagatatg

SEQ ID NO: 412458 - DNA, 45 bp, Artificial Sequence
  Description of Artificial Sequence: Synthetic oligonucleotide
gtgagacatgaagtaattttcccaagtctacaacagtaagatatg

SEQ ID NO: 412459 - DNA, 45 bp, Artificial Sequence
  Description of Artificial Sequence: Synthetic oligonucleotide
tgagacatgaagtaattttcccaagtctacaacagtaagatatgg

SEQ ID NO: 412460 - DNA, 44 bp, Artificial Sequence
  Description of Artificial Sequence: Synthetic oligonucleotide
gagacatgaagtaattttcccaagtctacaacagtaagatatgg

SEQ ID NO: 412461 - DNA, 45 bp, Artificial Sequence
  Description of Artificial Sequence: Synthetic oligonucleotide
agacatgaagtaattttcccaagtctacaacagtaagatatggtg

SEQ ID NO: 412462 - DNA, 44 bp, Artificial Sequence
  Description of Artificial Sequence: Synthetic oligonucleotide
gacatgaagtaattttcccaagtctacaacagtaagatatggtg

SEQ ID NO: 412463 - DNA, 44 bp, Artificial Sequence
  Description of Artificial Sequence: Synthetic oligonucleotide
acatgaagtaattttcccaagtctacaacagtaagatatggtgc

SEQ ID NO: 412464 - DNA, 43 bp, Artificial Sequence
  Description of Artificial Sequence: Synthetic oligonucleotide
catgaagtaattttcccaagtctacaacagtaagatatggtgc

SEQ ID NO: 412465 - DNA, 48 bp, Artificial Sequence
  Description of Artificial Sequence: Synthetic oligonucleotide
atgaagtaattttcccaagtctacaacagtaagatatggtgcaataag

SEQ ID NO: 412466 - DNA, 47 bp, Artificial Sequence
  Description of Artificial Sequence: Synthetic oligonucleotide
tgaagtaattttcccaagtctacaacagtaagatatggtgcaataag

SEQ ID NO: 412467 - DNA, 46 bp, Artificial Sequence
  Description of Artificial Sequence: Synthetic oligonucleotide
gaagtaattttcccaagtctacaacagtaagatatggtgcaataag

SEQ ID NO: 412468 - DNA, 46 bp, Artificial Sequence
  Description of Artificial Sequence: Synthetic oligonucleotide
aagtaattttcccaagtctacaacagtaagatatggtgcaataagg

SEQ ID NO: 412469 - DNA, 45 bp, Artificial Sequence
  Description of Artificial Sequence: Synthetic oligonucleotide
agtaattttcccaagtctacaacagtaagatatggtgcaataagg

SEQ ID NO: 412470 - DNA, 44 bp, Artificial Sequence
  Description of Artificial Sequence: Synthetic oligonucleotide
gtaattttcccaagtctacaacagtaagatatggtgcaataagg

SEQ ID NO: 412471 - DNA, 45 bp, Artificial Sequence
  Description of Artificial Sequence: Synthetic oligonucleotide
taattttcccaagtctacaacagtaagatatggtgcaataaggac

SEQ ID NO: 412472 - DNA, 44 bp, Artificial Sequence
  Description of Artificial Sequence: Synthetic oligonucleotide
aattttcccaagtctacaacagtaagatatggtgcaataaggac

SEQ ID NO: 412473 - DNA, 43 bp, Artificial Sequence
  Description of Artificial Sequence: Synthetic oligonucleotide
attttcccaagtctacaacagtaagatatggtgcaataaggac

SEQ ID NO: 412474 - DNA, 42 bp, Artificial Sequence
  Description of Artificial Sequence: Synthetic oligonucleotide
ttttcccaagtctacaacagtaagatatggtgcaataaggac

SEQ ID NO: 412475 - DNA, 41 bp, Artificial Sequence
  Description of Artificial Sequence: Synthetic oligonucleotide
tttcccaagtctacaacagtaagatatggtgcaataaggac

SEQ ID NO: 412476 - DNA, 40 bp, Artificial Sequence
  Description of Artificial Sequence: Synthetic oligonucleotide
ttcccaagtctacaacagtaagatatggtgcaataaggac

SEQ ID NO: 412477 - DNA, 39 bp, Artificial Sequence
  Description of Artificial Sequence: Synthetic oligonucleotide
tcccaagtctacaacagtaagatatggtgcaataaggac

SEQ ID NO: 412478 - DNA, 38 bp, Artificial Sequence
  Description of Artificial Sequence: Synthetic oligonucleotide
cccaagtctacaacagtaagatatggtgcaataaggac

SEQ ID NO: 412479 - DNA, 38 bp, Artificial Sequence
  Description of Artificial Sequence: Synthetic oligonucleotide
ccaagtctacaacagtaagatatggtgcaataaggacc

SEQ ID NO: 412480 - DNA, 39 bp, Artificial Sequence
  Description of Artificial Sequence: Synthetic oligonucleotide
caagtctacaacagtaagatatggtgcaataaggaccag

SEQ ID NO: 412481 - DNA, 46 bp, Artificial Sequence
  Description of Artificial Sequence: Synthetic oligonucleotide
aagtctacaacagtaagatatggtgcaataaggaccagattaaaag

SEQ ID NO: 412482 - DNA, 45 bp, Artificial Sequence
  Description of Artificial Sequence: Synthetic oligonucleotide
agtctacaacagtaagatatggtgcaataaggaccagattaaaag

SEQ ID NO: 412483 - DNA, 44 bp, Artificial Sequence
  Description of Artificial Sequence: Synthetic oligonucleotide
gtctacaacagtaagatatggtgcaataaggaccagattaaaag

SEQ ID NO: 412484 - DNA, 45 bp, Artificial Sequence
  Description of Artificial Sequence: Synthetic oligonucleotide
tctacaacagtaagatatggtgcaataaggaccagattaaaagtc

SEQ ID NO: 412485 - DNA, 44 bp, Artificial Sequence
  Description of Artificial Sequence: Synthetic oligonucleotide
ctacaacagtaagatatggtgcaataaggaccagattaaaagtc

SEQ ID NO: 412486 - DNA, 45 bp, Artificial Sequence
  Description of Artificial Sequence: Synthetic oligonucleotide
tacaacagtaagatatggtgcaataaggaccagattaaaagtctc

SEQ ID NO: 412487 - DNA, 44 bp, Artificial Sequence
  Description of Artificial Sequence: Synthetic oligonucleotide
acaacagtaagatatggtgcaataaggaccagattaaaagtctc

SEQ ID NO: 412488 - DNA, 43 bp, Artificial Sequence
  Description of Artificial Sequence: Synthetic oligonucleotide
caacagtaagatatggtgcaataaggaccagattaaaagtctc

SEQ ID NO: 412489 - DNA, 43 bp, Artificial Sequence
  Description of Artificial Sequence: Synthetic oligonucleotide
aacagtaagatatggtgcaataaggaccagattaaaagtctcc

SEQ ID NO: 412490 - DNA, 42 bp, Artificial Sequence
  Description of Artificial Sequence: Synthetic oligonucleotide
acagtaagatatggtgcaataaggaccagattaaaagtctcc

SEQ ID NO: 412491 - DNA, 41 bp, Artificial Sequence
  Description of Artificial Sequence: Synthetic oligonucleotide
cagtaagatatggtgcaataaggaccagattaaaagtctcc

SEQ ID NO: 412492 - DNA, 42 bp, Artificial Sequence
  Description of Artificial Sequence: Synthetic oligonucleotide
agtaagatatggtgcaataaggaccagattaaaagtctcctg

SEQ ID NO: 412493 - DNA, 41 bp, Artificial Sequence
  Description of Artificial Sequence: Synthetic oligonucleotide
gtaagatatggtgcaataaggaccagattaaaagtctcctg

SEQ ID NO: 412494 - DNA, 45 bp, Artificial Sequence
  Description of Artificial Sequence: Synthetic oligonucleotide
taagatatggtgcaataaggaccagattaaaagtctcctgatttg

SEQ ID NO: 412495 - DNA, 44 bp, Artificial Sequence
  Description of Artificial Sequence: Synthetic oligonucleotide
aagatatggtgcaataaggaccagattaaaagtctcctgatttg

SEQ ID NO: 412496 - DNA, 43 bp, Artificial Sequence
  Description of Artificial Sequence: Synthetic oligonucleotide
agatatggtgcaataaggaccagattaaaagtctcctgatttg

SEQ ID NO: 412497 - DNA, 42 bp, Artificial Sequence
  Description of Artificial Sequence: Synthetic oligonucleotide
gatatggtgcaataaggaccagattaaaagtctcctgatttg

SEQ ID NO: 412498 - DNA, 42 bp, Artificial Sequence
  Description of Artificial Sequence: Synthetic oligonucleotide
atatggtgcaataaggaccagattaaaagtctcctgatttgc

SEQ ID NO: 412499 - DNA, 41 bp, Artificial Sequence
  Description of Artificial Sequence: Synthetic oligonucleotide
tatggtgcaataaggaccagattaaaagtctcctgatttgc

SEQ ID NO: 412500 - DNA, 40 bp, Artificial Sequence
  Description of Artificial Sequence: Synthetic oligonucleotide
atggtgcaataaggaccagattaaaagtctcctgatttgc

SEQ ID NO: 412501 - DNA, 39 bp, Artificial Sequence
  Description of Artificial Sequence: Synthetic oligonucleotide
tggtgcaataaggaccagattaaaagtctcctgatttgc

SEQ ID NO: 412502 - DNA, 38 bp, Artificial Sequence
  Description of Artificial Sequence: Synthetic oligonucleotide
ggtgcaataaggaccagattaaaagtctcctgatttgc

SEQ ID NO: 412503 - DNA, 40 bp, Artificial Sequence
  Description of Artificial Sequence: Synthetic oligonucleotide
gtgcaataaggaccagattaaaagtctcctgatttgcaac

SEQ ID NO: 412504 - DNA, 40 bp, Artificial Sequence
  Description of Artificial Sequence: Synthetic oligonucleotide
tgcaataaggaccagattaaaagtctcctgatttgcaacc

SEQ ID NO: 412505 - DNA, 39 bp, Artificial Sequence
  Description of Artificial Sequence: Synthetic oligonucleotide
gcaataaggaccagattaaaagtctcctgatttgcaacc

SEQ ID NO: 412506 - DNA, 41 bp, Artificial Sequence
  Description of Artificial Sequence: Synthetic oligonucleotide
caataaggaccagattaaaagtctcctgatttgcaaccatg

SEQ ID NO: 412507 - DNA, 43 bp, Artificial Sequence
  Description of Artificial Sequence: Synthetic oligonucleotide
aataaggaccagattaaaagtctcctgatttgcaaccatgttc

SEQ ID NO: 412508 - DNA, 42 bp, Artificial Sequence
  Description of Artificial Sequence: Synthetic oligonucleotide
ataaggaccagattaaaagtctcctgatttgcaaccatgttc

SEQ ID NO: 412509 - DNA, 41 bp, Artificial Sequence
  Description of Artificial Sequence: Synthetic oligonucleotide
taaggaccagattaaaagtctcctgatttgcaaccatgttc

SEQ ID NO: 412510 - DNA, 40 bp, Artificial Sequence
  Description of Artificial Sequence: Synthetic oligonucleotide
aaggaccagattaaaagtctcctgatttgcaaccatgttc

SEQ ID NO: 412511 - DNA, 39 bp, Artificial Sequence
  Description of Artificial Sequence: Synthetic oligonucleotide
aggaccagattaaaagtctcctgatttgcaaccatgttc

SEQ ID NO: 412512 - DNA, 38 bp, Artificial Sequence
  Description of Artificial Sequence: Synthetic oligonucleotide
ggaccagattaaaagtctcctgatttgcaaccatgttc

SEQ ID NO: 412513 - DNA, 38 bp, Artificial Sequence
  Description of Artificial Sequence: Synthetic oligonucleotide
gaccagattaaaagtctcctgatttgcaaccatgttcc

SEQ ID NO: 412514 - DNA, 38 bp, Artificial Sequence
  Description of Artificial Sequence: Synthetic oligonucleotide
accagattaaaagtctcctgatttgcaaccatgttccc

SEQ ID NO: 412515 - DNA, 37 bp, Artificial Sequence
  Description of Artificial Sequence: Synthetic oligonucleotide
ccagattaaaagtctcctgatttgcaaccatgttccc

SEQ ID NO: 412516 - DNA, 38 bp, Artificial Sequence
  Description of Artificial Sequence: Synthetic oligonucleotide
cagattaaaagtctcctgatttgcaaccatgttccctc

SEQ ID NO: 412517 - DNA, 38 bp, Artificial Sequence
  Description of Artificial Sequence: Synthetic oligonucleotide
agattaaaagtctcctgatttgcaaccatgttccctcc

SEQ ID NO: 412518 - DNA, 37 bp, Artificial Sequence
  Description of Artificial Sequence: Synthetic oligonucleotide
gattaaaagtctcctgatttgcaaccatgttccctcc

SEQ ID NO: 412519 - DNA, 39 bp, Artificial Sequence
  Description of Artificial Sequence: Synthetic oligonucleotide
attaaaagtctcctgatttgcaaccatgttccctccatc

SEQ ID NO: 412520 - DNA, 38 bp, Artificial Sequence
  Description of Artificial Sequence: Synthetic oligonucleotide
ttaaaagtctcctgatttgcaaccatgttccctccatc

SEQ ID NO: 412521 - DNA, 37 bp, Artificial Sequence
  Description of Artificial Sequence: Synthetic oligonucleotide
taaaagtctcctgatttgcaaccatgttccctccatc

SEQ ID NO: 412522 - DNA, 36 bp, Artificial Sequence
  Description of Artificial Sequence: Synthetic oligonucleotide
aaaagtctcctgatttgcaaccatgttccctccatc

SEQ ID NO: 412523 - DNA, 35 bp, Artificial Sequence
  Description of Artificial Sequence: Synthetic oligonucleotide
aaagtctcctgatttgcaaccatgttccctccatc

SEQ ID NO: 412524 - DNA, 34 bp, Artificial Sequence
  Description of Artificial Sequence: Synthetic oligonucleotide
aagtctcctgatttgcaaccatgttccctccatc

SEQ ID NO: 412525 - DNA, 33 bp, Artificial Sequence
  Description of Artificial Sequence: Synthetic oligonucleotide
agtctcctgatttgcaaccatgttccctccatc

SEQ ID NO: 412526 - DNA, 32 bp, Artificial Sequence
  Description of Artificial Sequence: Synthetic oligonucleotide
gtctcctgatttgcaaccatgttccctccatc

SEQ ID NO: 412527 - DNA, 33 bp, Artificial Sequence
  Description of Artificial Sequence: Synthetic oligonucleotide
tctcctgatttgcaaccatgttccctccatctc

SEQ ID NO: 412528 - DNA, 32 bp, Artificial Sequence
  Description of Artificial Sequence: Synthetic oligonucleotide
ctcctgatttgcaaccatgttccctccatctc

SEQ ID NO: 412529 - DNA, 32 bp, Artificial Sequence
  Description of Artificial Sequence: Synthetic oligonucleotide
tcctgatttgcaaccatgttccctccatctcc

SEQ ID NO: 412530 - DNA, 31 bp, Artificial Sequence
  Description of Artificial Sequence: Synthetic oligonucleotide
cctgatttgcaaccatgttccctccatctcc

SEQ ID NO: 412531 - DNA, 35 bp, Artificial Sequence
  Description of Artificial Sequence: Synthetic oligonucleotide
ctgatttgcaaccatgttccctccatctcctttac

SEQ ID NO: 412532 - DNA, 36 bp, Artificial Sequence
  Description of Artificial Sequence: Synthetic oligonucleotide
tgatttgcaaccatgttccctccatctcctttactc

SEQ ID NO: 412533 - DNA, 35 bp, Artificial Sequence
  Description of Artificial Sequence: Synthetic oligonucleotide
gatttgcaaccatgttccctccatctcctttactc

SEQ ID NO: 412534 - DNA, 35 bp, Artificial Sequence
  Description of Artificial Sequence: Synthetic oligonucleotide
atttgcaaccatgttccctccatctcctttactcc

SEQ ID NO: 412535 - DNA, 34 bp, Artificial Sequence
  Description of Artificial Sequence: Synthetic oligonucleotide
tttgcaaccatgttccctccatctcctttactcc

SEQ ID NO: 412536 - DNA, 33 bp, Artificial Sequence
  Description of Artificial Sequence: Synthetic oligonucleotide
ttgcaaccatgttccctccatctcctttactcc

SEQ ID NO: 412537 - DNA, 32 bp, Artificial Sequence
  Description of Artificial Sequence: Synthetic oligonucleotide
tgcaaccatgttccctccatctcctttactcc

SEQ ID NO: 412538 - DNA, 31 bp, Artificial Sequence
  Description of Artificial Sequence: Synthetic oligonucleotide
gcaaccatgttccctccatctcctttactcc

SEQ ID NO: 412539 - DNA, 34 bp, Artificial Sequence
  Description of Artificial Sequence: Synthetic oligonucleotide
caaccatgttccctccatctcctttactcctaag

SEQ ID NO: 412540 - DNA, 34 bp, Artificial Sequence
  Description of Artificial Sequence: Synthetic oligonucleotide
aaccatgttccctccatctcctttactcctaagc

SEQ ID NO: 412541 - DNA, 33 bp, Artificial Sequence
  Description of Artificial Sequence: Synthetic oligonucleotide
accatgttccctccatctcctttactcctaagc

SEQ ID NO: 412542 - DNA, 32 bp, Artificial Sequence
  Description of Artificial Sequence: Synthetic oligonucleotide
ccatgttccctccatctcctttactcctaagc

SEQ ID NO: 412543 - DNA, 33 bp, Artificial Sequence
  Description of Artificial Sequence: Synthetic oligonucleotide
catgttccctccatctcctttactcctaagcac

SEQ ID NO: 412544 - DNA, 34 bp, Artificial Sequence
  Description of Artificial Sequence: Synthetic oligonucleotide
atgttccctccatctcctttactcctaagcacac

SEQ ID NO: 412545 - DNA, 33 bp, Artificial Sequence
  Description of Artificial Sequence: Synthetic oligonucleotide
tgttccctccatctcctttactcctaagcacac

SEQ ID NO: 412546 - DNA, 32 bp, Artificial Sequence
  Description of Artificial Sequence: Synthetic oligonucleotide
gttccctccatctcctttactcctaagcacac

SEQ ID NO: 412547 - DNA, 33 bp, Artificial Sequence
  Description of Artificial Sequence: Synthetic oligonucleotide
ttccctccatctcctttactcctaagcacactc

SEQ ID NO: 412548 - DNA, 32 bp, Artificial Sequence
  Description of Artificial Sequence: Synthetic oligonucleotide
tccctccatctcctttactcctaagcacactc

SEQ ID NO: 412549 - DNA, 31 bp, Artificial Sequence
  Description of Artificial Sequence: Synthetic oligonucleotide
ccctccatctcctttactcctaagcacactc

SEQ ID NO: 412550 - DNA, 32 bp, Artificial Sequence
  Description of Artificial Sequence: Synthetic oligonucleotide
cctccatctcctttactcctaagcacactcac

SEQ ID NO: 412551 - DNA, 33 bp, Artificial Sequence
  Description of Artificial Sequence: Synthetic oligonucleotide
ctccatctcctttactcctaagcacactcacac

SEQ ID NO: 412552 - DNA, 34 bp, Artificial Sequence
  Description of Artificial Sequence: Synthetic oligonucleotide
tccatctcctttactcctaagcacactcacacac

SEQ ID NO: 412553 - DNA, 33 bp, Artificial Sequence
  Description of Artificial Sequence: Synthetic oligonucleotide
ccatctcctttactcctaagcacactcacacac

SEQ ID NO: 412554 - DNA, 34 bp, Artificial Sequence
  Description of Artificial Sequence: Synthetic oligonucleotide
catctcctttactcctaagcacactcacacactc

SEQ ID NO: 412555 - DNA, 35 bp, Artificial Sequence
  Description of Artificial Sequence: Synthetic oligonucleotide
atctcctttactcctaagcacactcacacactcac

SEQ ID NO: 412556 - DNA, 34 bp, Artificial Sequence
  Description of Artificial Sequence: Synthetic oligonucleotide
tctcctttactcctaagcacactcacacactcac

SEQ ID NO: 412557 - DNA, 33 bp, Artificial Sequence
  Description of Artificial Sequence: Synthetic oligonucleotide
ctcctttactcctaagcacactcacacactcac

SEQ ID NO: 412558 - DNA, 34 bp, Artificial Sequence
  Description of Artificial Sequence: Synthetic oligonucleotide
tcctttactcctaagcacactcacacactcactc

SEQ ID NO: 412559 - DNA, 33 bp, Artificial Sequence
  Description of Artificial Sequence: Synthetic oligonucleotide
cctttactcctaagcacactcacacactcactc

SEQ ID NO: 412560 - DNA, 33 bp, Artificial Sequence
  Description of Artificial Sequence: Synthetic oligonucleotide
ctttactcctaagcacactcacacactcactcc

SEQ ID NO: 412561 - DNA, 34 bp, Artificial Sequence
  Description of Artificial Sequence: Synthetic oligonucleotide
tttactcctaagcacactcacacactcactcctg

SEQ ID NO: 412562 - DNA, 33 bp, Artificial Sequence
  Description of Artificial Sequence: Synthetic oligonucleotide
ttactcctaagcacactcacacactcactcctg

SEQ ID NO: 412563 - DNA, 32 bp, Artificial Sequence
  Description of Artificial Sequence: Synthetic oligonucleotide
tactcctaagcacactcacacactcactcctg

SEQ ID NO: 412564 - DNA, 31 bp, Artificial Sequence
  Description of Artificial Sequence: Synthetic oligonucleotide
actcctaagcacactcacacactcactcctg

SEQ ID NO: 412565 - DNA, 30 bp, Artificial Sequence
  Description of Artificial Sequence: Synthetic oligonucleotide
ctcctaagcacactcacacactcactcctg

SEQ ID NO: 412566 - DNA, 30 bp, Artificial Sequence
  Description of Artificial Sequence: Synthetic oligonucleotide
tcctaagcacactcacacactcactcctgc

SEQ ID NO: 412567 - DNA, 29 bp, Artificial Sequence
  Description of Artificial Sequence: Synthetic oligonucleotide
cctaagcacactcacacactcactcctgc

SEQ ID NO: 412568 - DNA, 32 bp, Artificial Sequence
  Description of Artificial Sequence: Synthetic oligonucleotide
ctaagcacactcacacactcactcctgcaaac

SEQ ID NO: 412569 - DNA, 36 bp, Artificial Sequence
  Description of Artificial Sequence: Synthetic oligonucleotide
taagcacactcacacactcactcctgcaaacaattc

SEQ ID NO: 412570 - DNA, 35 bp, Artificial Sequence
  Description of Artificial Sequence: Synthetic oligonucleotide
aagcacactcacacactcactcctgcaaacaattc

SEQ ID NO: 412571 - DNA, 34 bp, Artificial Sequence
  Description of Artificial Sequence: Synthetic oligonucleotide
agcacactcacacactcactcctgcaaacaattc

SEQ ID NO: 412572 - DNA, 33 bp, Artificial Sequence
  Description of Artificial Sequence: Synthetic oligonucleotide
gcacactcacacactcactcctgcaaacaattc

SEQ ID NO: 412573 - DNA, 34 bp, Artificial Sequence
  Description of Artificial Sequence: Synthetic oligonucleotide
cacactcacacactcactcctgcaaacaattctc

SEQ ID NO: 412574 - DNA, 36 bp, Artificial Sequence
  Description of Artificial Sequence: Synthetic oligonucleotide
acactcacacactcactcctgcaaacaattctcttg

SEQ ID NO: 412575 - DNA, 35 bp, Artificial Sequence
  Description of Artificial Sequence: Synthetic oligonucleotide
cactcacacactcactcctgcaaacaattctcttg

SEQ ID NO: 412576 - DNA, 36 bp, Artificial Sequence
  Description of Artificial Sequence: Synthetic oligonucleotide
actcacacactcactcctgcaaacaattctcttgtc

SEQ ID NO: 412577 - DNA, 35 bp, Artificial Sequence
  Description of Artificial Sequence: Synthetic oligonucleotide
ctcacacactcactcctgcaaacaattctcttgtc

SEQ ID NO: 412578 - DNA, 37 bp, Artificial Sequence
  Description of Artificial Sequence: Synthetic oligonucleotide
tcacacactcactcctgcaaacaattctcttgtcaag

SEQ ID NO: 412579 - DNA, 36 bp, Artificial Sequence
  Description of Artificial Sequence: Synthetic oligonucleotide
cacacactcactcctgcaaacaattctcttgtcaag

SEQ ID NO: 412580 - DNA, 37 bp, Artificial Sequence
  Description of Artificial Sequence: Synthetic oligonucleotide
acacactcactcctgcaaacaattctcttgtcaagtg

SEQ ID NO: 412581 - DNA, 36 bp, Artificial Sequence
  Description of Artificial Sequence: Synthetic oligonucleotide
cacactcactcctgcaaacaattctcttgtcaagtg

SEQ ID NO: 412582 - DNA, 36 bp, Artificial Sequence
  Description of Artificial Sequence: Synthetic oligonucleotide
acactcactcctgcaaacaattctcttgtcaagtgg

SEQ ID NO: 412583 - DNA, 35 bp, Artificial Sequence
  Description of Artificial Sequence: Synthetic oligonucleotide
cactcactcctgcaaacaattctcttgtcaagtgg

SEQ ID NO: 412584 - DNA, 35 bp, Artificial Sequence
  Description of Artificial Sequence: Synthetic oligonucleotide
actcactcctgcaaacaattctcttgtcaagtggg

SEQ ID NO: 412585 - DNA, 34 bp, Artificial Sequence
  Description of Artificial Sequence: Synthetic oligonucleotide
ctcactcctgcaaacaattctcttgtcaagtggg

SEQ ID NO: 412586 - DNA, 38 bp, Artificial Sequence
  Description of Artificial Sequence: Synthetic oligonucleotide
tcactcctgcaaacaattctcttgtcaagtgggaaatg

SEQ ID NO: 412587 - DNA, 37 bp, Artificial Sequence
  Description of Artificial Sequence: Synthetic oligonucleotide
cactcctgcaaacaattctcttgtcaagtgggaaatg

SEQ ID NO: 412588 - DNA, 40 bp, Artificial Sequence
  Description of Artificial Sequence: Synthetic oligonucleotide
actcctgcaaacaattctcttgtcaagtgggaaatgaatg

SEQ ID NO: 412589 - DNA, 39 bp, Artificial Sequence
  Description of Artificial Sequence: Synthetic oligonucleotide
ctcctgcaaacaattctcttgtcaagtgggaaatgaatg

SEQ ID NO: 412590 - DNA, 39 bp, Artificial Sequence
  Description of Artificial Sequence: Synthetic oligonucleotide
tcctgcaaacaattctcttgtcaagtgggaaatgaatgc

SEQ ID NO: 412591 - DNA, 38 bp, Artificial Sequence
  Description of Artificial Sequence: Synthetic oligonucleotide
cctgcaaacaattctcttgtcaagtgggaaatgaatgc

SEQ ID NO: 412592 - DNA, 39 bp, Artificial Sequence
  Description of Artificial Sequence: Synthetic oligonucleotide
ctgcaaacaattctcttgtcaagtgggaaatgaatgctc

SEQ ID NO: 412593 - DNA, 42 bp, Artificial Sequence
  Description of Artificial Sequence: Synthetic oligonucleotide
tgcaaacaattctcttgtcaagtgggaaatgaatgctcttac

SEQ ID NO: 412594 - DNA, 41 bp, Artificial Sequence
  Description of Artificial Sequence: Synthetic oligonucleotide
gcaaacaattctcttgtcaagtgggaaatgaatgctcttac

SEQ ID NO: 412595 - DNA, 43 bp, Artificial Sequence
  Description of Artificial Sequence: Synthetic oligonucleotide
caaacaattctcttgtcaagtgggaaatgaatgctcttacaag

SEQ ID NO: 412596 - DNA, 43 bp, Artificial Sequence
  Description of Artificial Sequence: Synthetic oligonucleotide
aaacaattctcttgtcaagtgggaaatgaatgctcttacaagg

SEQ ID NO: 412597 - DNA, 42 bp, Artificial Sequence
  Description of Artificial Sequence: Synthetic oligonucleotide
aacaattctcttgtcaagtgggaaatgaatgctcttacaagg

SEQ ID NO: 412598 - DNA, 41 bp, Artificial Sequence
  Description of Artificial Sequence: Synthetic oligonucleotide
acaattctcttgtcaagtgggaaatgaatgctcttacaagg

SEQ ID NO: 412599 - DNA, 40 bp, Artificial Sequence
  Description of Artificial Sequence: Synthetic oligonucleotide
caattctcttgtcaagtgggaaatgaatgctcttacaagg

SEQ ID NO: 412600 - DNA, 40 bp, Artificial Sequence
  Description of Artificial Sequence: Synthetic oligonucleotide
aattctcttgtcaagtgggaaatgaatgctcttacaaggc

SEQ ID NO: 412601 - DNA, 39 bp, Artificial Sequence
  Description of Artificial Sequence: Synthetic oligonucleotide
attctcttgtcaagtgggaaatgaatgctcttacaaggc

SEQ ID NO: 412602 - DNA, 42 bp, Artificial Sequence
  Description of Artificial Sequence: Synthetic oligonucleotide
ttgtcaagtgggaaatgaatgctcttacaaggctcaaatttg

SEQ ID NO: 412603 - DNA, 41 bp, Artificial Sequence
  Description of Artificial Sequence: Synthetic oligonucleotide
tgtcaagtgggaaatgaatgctcttacaaggctcaaatttg

SEQ ID NO: 412604 - DNA, 40 bp, Artificial Sequence
  Description of Artificial Sequence: Synthetic oligonucleotide
gtcaagtgggaaatgaatgctcttacaaggctcaaatttg

SEQ ID NO: 412605 - DNA, 41 bp, Artificial Sequence
  Description of Artificial Sequence: Synthetic oligonucleotide
tcaagtgggaaatgaatgctcttacaaggctcaaatttgtg

SEQ ID NO: 412606 - DNA, 40 bp, Artificial Sequence
  Description of Artificial Sequence: Synthetic oligonucleotide
caagtgggaaatgaatgctcttacaaggctcaaatttgtg

SEQ ID NO: 412607 - DNA, 42 bp, Artificial Sequence
  Description of Artificial Sequence: Synthetic oligonucleotide
aagtgggaaatgaatgctcttacaaggctcaaatttgtgaac

SEQ ID NO: 412608 - DNA, 41 bp, Artificial Sequence
  Description of Artificial Sequence: Synthetic oligonucleotide
agtgggaaatgaatgctcttacaaggctcaaatttgtgaac

SEQ ID NO: 412609 - DNA, 40 bp, Artificial Sequence
  Description of Artificial Sequence: Synthetic oligonucleotide
gtgggaaatgaatgctcttacaaggctcaaatttgtgaac

SEQ ID NO: 412610 - DNA, 41 bp, Artificial Sequence
  Description of Artificial Sequence: Synthetic oligonucleotide
tgggaaatgaatgctcttacaaggctcaaatttgtgaacac

SEQ ID NO: 412611 - DNA, 40 bp, Artificial Sequence
  Description of Artificial Sequence: Synthetic oligonucleotide
gggaaatgaatgctcttacaaggctcaaatttgtgaacac

SEQ ID NO: 412612 - DNA, 42 bp, Artificial Sequence
  Description of Artificial Sequence: Synthetic oligonucleotide
ggaaatgaatgctcttacaaggctcaaatttgtgaacacatc

SEQ ID NO: 412613 - DNA, 43 bp, Artificial Sequence
  Description of Artificial Sequence: Synthetic oligonucleotide
gaaatgaatgctcttacaaggctcaaatttgtgaacacatcac

SEQ ID NO: 412614 - DNA, 44 bp, Artificial Sequence
  Description of Artificial Sequence: Synthetic oligonucleotide
aaatgaatgctcttacaaggctcaaatttgtgaacacatcactg

SEQ ID NO: 412615 - DNA, 43 bp, Artificial Sequence
  Description of Artificial Sequence: Synthetic oligonucleotide
aatgaatgctcttacaaggctcaaatttgtgaacacatcactg

SEQ ID NO: 412616 - DNA, 42 bp, Artificial Sequence
  Description of Artificial Sequence: Synthetic oligonucleotide
atgaatgctcttacaaggctcaaatttgtgaacacatcactg

SEQ ID NO: 412617 - DNA, 41 bp, Artificial Sequence
  Description of Artificial Sequence: Synthetic oligonucleotide
tgaatgctcttacaaggctcaaatttgtgaacacatcactg

SEQ ID NO: 412618 - DNA, 40 bp, Artificial Sequence
  Description of Artificial Sequence: Synthetic oligonucleotide
gaatgctcttacaaggctcaaatttgtgaacacatcactg

SEQ ID NO: 412619 - DNA, 41 bp, Artificial Sequence
  Description of Artificial Sequence: Synthetic oligonucleotide
aatgctcttacaaggctcaaatttgtgaacacatcactgac

SEQ ID NO: 412620 - DNA, 40 bp, Artificial Sequence
  Description of Artificial Sequence: Synthetic oligonucleotide
atgctcttacaaggctcaaatttgtgaacacatcactgac

SEQ ID NO: 412621 - DNA, 39 bp, Artificial Sequence
  Description of Artificial Sequence: Synthetic oligonucleotide
tgctcttacaaggctcaaatttgtgaacacatcactgac

SEQ ID NO: 412622 - DNA, 38 bp, Artificial Sequence
  Description of Artificial Sequence: Synthetic oligonucleotide
gctcttacaaggctcaaatttgtgaacacatcactgac

SEQ ID NO: 412623 - DNA, 38 bp, Artificial Sequence
  Description of Artificial Sequence: Synthetic oligonucleotide
ctcttacaaggctcaaatttgtgaacacatcactgacc

SEQ ID NO: 412624 - DNA, 39 bp, Artificial Sequence
  Description of Artificial Sequence: Synthetic oligonucleotide
tcttacaaggctcaaatttgtgaacacatcactgaccag

SEQ ID NO: 412625 - DNA, 38 bp, Artificial Sequence
  Description of Artificial Sequence: Synthetic oligonucleotide
cttacaaggctcaaatttgtgaacacatcactgaccag

SEQ ID NO: 412626 - DNA, 38 bp, Artificial Sequence
  Description of Artificial Sequence: Synthetic oligonucleotide
ttacaaggctcaaatttgtgaacacatcactgaccagc

SEQ ID NO: 412627 - DNA, 37 bp, Artificial Sequence
  Description of Artificial Sequence: Synthetic oligonucleotide
tacaaggctcaaatttgtgaacacatcactgaccagc

SEQ ID NO: 412628 - DNA, 36 bp, Artificial Sequence
  Description of Artificial Sequence: Synthetic oligonucleotide
acaaggctcaaatttgtgaacacatcactgaccagc

SEQ ID NO: 412629 - DNA, 35 bp, Artificial Sequence
  Description of Artificial Sequence: Synthetic oligonucleotide
caaggctcaaatttgtgaacacatcactgaccagc

SEQ ID NO: 412630 - DNA, 36 bp, Artificial Sequence
  Description of Artificial Sequence: Synthetic oligonucleotide
aaggctcaaatttgtgaacacatcactgaccagcac

SEQ ID NO: 412631 - DNA, 35 bp, Artificial Sequence
  Description of Artificial Sequence: Synthetic oligonucleotide
aggctcaaatttgtgaacacatcactgaccagcac

SEQ ID NO: 412632 - DNA, 34 bp, Artificial Sequence
  Description of Artificial Sequence: Synthetic oligonucleotide
ggctcaaatttgtgaacacatcactgaccagcac

SEQ ID NO: 412633 - DNA, 35 bp, Artificial Sequence
  Description of Artificial Sequence: Synthetic oligonucleotide
gctcaaatttgtgaacacatcactgaccagcacag

SEQ ID NO: 412634 - DNA, 36 bp, Artificial Sequence
  Description of Artificial Sequence: Synthetic oligonucleotide
ctcaaatttgtgaacacatcactgaccagcacagag

SEQ ID NO: 412635 - DNA, 36 bp, Artificial Sequence
  Description of Artificial Sequence: Synthetic oligonucleotide
tcaaatttgtgaacacatcactgaccagcacagagc

SEQ ID NO: 412636 - DNA, 35 bp, Artificial Sequence
  Description of Artificial Sequence: Synthetic oligonucleotide
caaatttgtgaacacatcactgaccagcacagagc

SEQ ID NO: 412637 - DNA, 36 bp, Artificial Sequence
  Description of Artificial Sequence: Synthetic oligonucleotide
aaatttgtgaacacatcactgaccagcacagagctg

SEQ ID NO: 412638 - DNA, 35 bp, Artificial Sequence
  Description of Artificial Sequence: Synthetic oligonucleotide
aatttgtgaacacatcactgaccagcacagagctg

SEQ ID NO: 412639 - DNA, 34 bp, Artificial Sequence
  Description of Artificial Sequence: Synthetic oligonucleotide
atttgtgaacacatcactgaccagcacagagctg

SEQ ID NO: 412640 - DNA, 33 bp, Artificial Sequence
  Description of Artificial Sequence: Synthetic oligonucleotide
tttgtgaacacatcactgaccagcacagagctg

SEQ ID NO: 412641 - DNA, 30 bp, Artificial Sequence
  Description of Artificial Sequence: Synthetic oligonucleotide
acatcactgaccagcacagagctggctaac

SEQ ID NO: 412642 - DNA, 29 bp, Artificial Sequence
  Description of Artificial Sequence: Synthetic oligonucleotide
catcactgaccagcacagagctggctaac

SEQ ID NO: 412643 - DNA, 33 bp, Artificial Sequence
  Description of Artificial Sequence: Synthetic oligonucleotide
atcactgaccagcacagagctggctaacaatag

SEQ ID NO: 412644 - DNA, 32 bp, Artificial Sequence
  Description of Artificial Sequence: Synthetic oligonucleotide
tcactgaccagcacagagctggctaacaatag

SEQ ID NO: 412645 - DNA, 31 bp, Artificial Sequence
  Description of Artificial Sequence: Synthetic oligonucleotide
cactgaccagcacagagctggctaacaatag

SEQ ID NO: 412646 - DNA, 31 bp, Artificial Sequence
  Description of Artificial Sequence: Synthetic oligonucleotide
actgaccagcacagagctggctaacaatagg

SEQ ID NO: 412647 - DNA, 30 bp, Artificial Sequence
  Description of Artificial Sequence: Synthetic oligonucleotide
ctgaccagcacagagctggctaacaatagg

SEQ ID NO: 412648 - DNA, 30 bp, Artificial Sequence
  Description of Artificial Sequence: Synthetic oligonucleotide
tgaccagcacagagctggctaacaataggg

SEQ ID NO: 412649 - DNA, 29 bp, Artificial Sequence
  Description of Artificial Sequence: Synthetic oligonucleotide
gaccagcacagagctggctaacaataggg

SEQ ID NO: 412650 - DNA, 30 bp, Artificial Sequence
  Description of Artificial Sequence: Synthetic oligonucleotide
accagcacagagctggctaacaatagggac

SEQ ID NO: 412651 - DNA, 29 bp, Artificial Sequence
  Description of Artificial Sequence: Synthetic oligonucleotide
ccagcacagagctggctaacaatagggac

SEQ ID NO: 412652 - DNA, 30 bp, Artificial Sequence
  Description of Artificial Sequence: Synthetic oligonucleotide
cagcacagagctggctaacaatagggacac

SEQ ID NO: 412653 - DNA, 36 bp, Artificial Sequence
  Description of Artificial Sequence: Synthetic oligonucleotide
agcacagagctggctaacaatagggacacaattaag

SEQ ID NO: 412654 - DNA, 35 bp, Artificial Sequence
  Description of Artificial Sequence: Synthetic oligonucleotide
gcacagagctggctaacaatagggacacaattaag

SEQ ID NO: 412655 - DNA, 35 bp, Artificial Sequence
  Description of Artificial Sequence: Synthetic oligonucleotide
cacagagctggctaacaatagggacacaattaagg

SEQ ID NO: 412656 - DNA, 36 bp, Artificial Sequence
  Description of Artificial Sequence: Synthetic oligonucleotide
acagagctggctaacaatagggacacaattaaggtg

SEQ ID NO: 412657 - DNA, 35 bp, Artificial Sequence
  Description of Artificial Sequence: Synthetic oligonucleotide
cagagctggctaacaatagggacacaattaaggtg

SEQ ID NO: 412658 - DNA, 40 bp, Artificial Sequence
  Description of Artificial Sequence: Synthetic oligonucleotide
agagctggctaacaatagggacacaattaaggtgttttac

SEQ ID NO: 412659 - DNA, 39 bp, Artificial Sequence
  Description of Artificial Sequence: Synthetic oligonucleotide
gagctggctaacaatagggacacaattaaggtgttttac

SEQ ID NO: 412660 - DNA, 40 bp, Artificial Sequence
  Description of Artificial Sequence: Synthetic oligonucleotide
agctggctaacaatagggacacaattaaggtgttttacac

SEQ ID NO: 412661 - DNA, 39 bp, Artificial Sequence
  Description of Artificial Sequence: Synthetic oligonucleotide
gctggctaacaatagggacacaattaaggtgttttacac

SEQ ID NO: 412662 - DNA, 39 bp, Artificial Sequence
  Description of Artificial Sequence: Synthetic oligonucleotide
ctggctaacaatagggacacaattaaggtgttttacacg

SEQ ID NO: 412663 - DNA, 39 bp, Artificial Sequence
  Description of Artificial Sequence: Synthetic oligonucleotide
tggctaacaatagggacacaattaaggtgttttacacgc

SEQ ID NO: 412664 - DNA, 38 bp, Artificial Sequence
  Description of Artificial Sequence: Synthetic oligonucleotide
ggctaacaatagggacacaattaaggtgttttacacgc

SEQ ID NO: 412665 - DNA, 40 bp, Artificial Sequence
  Description of Artificial Sequence: Synthetic oligonucleotide
gctaacaatagggacacaattaaggtgttttacacgcaac

SEQ ID NO: 412666 - DNA, 41 bp, Artificial Sequence
  Description of Artificial Sequence: Synthetic oligonucleotide
ctaacaatagggacacaattaaggtgttttacacgcaactg

SEQ ID NO: 412667 - DNA, 41 bp, Artificial Sequence
  Description of Artificial Sequence: Synthetic oligonucleotide
taacaatagggacacaattaaggtgttttacacgcaactgg

SEQ ID NO: 412668 - DNA, 40 bp, Artificial Sequence
  Description of Artificial Sequence: Synthetic oligonucleotide
aacaatagggacacaattaaggtgttttacacgcaactgg

SEQ ID NO: 412669 - DNA, 39 bp, Artificial Sequence
  Description of Artificial Sequence: Synthetic oligonucleotide
acaatagggacacaattaaggtgttttacacgcaactgg

SEQ ID NO: 412670 - DNA, 38 bp, Artificial Sequence
  Description of Artificial Sequence: Synthetic oligonucleotide
caatagggacacaattaaggtgttttacacgcaactgg

SEQ ID NO: 412671 - DNA, 40 bp, Artificial Sequence
  Description of Artificial Sequence: Synthetic oligonucleotide
aatagggacacaattaaggtgttttacacgcaactggttc

SEQ ID NO: 412672 - DNA, 39 bp, Artificial Sequence
  Description of Artificial Sequence: Synthetic oligonucleotide
atagggacacaattaaggtgttttacacgcaactggttc

SEQ ID NO: 412673 - DNA, 38 bp, Artificial Sequence
  Description of Artificial Sequence: Synthetic oligonucleotide
tagggacacaattaaggtgttttacacgcaactggttc

SEQ ID NO: 412674 - DNA, 37 bp, Artificial Sequence
  Description of Artificial Sequence: Synthetic oligonucleotide
agggacacaattaaggtgttttacacgcaactggttc

SEQ ID NO: 412675 - DNA, 36 bp, Artificial Sequence
  Description of Artificial Sequence: Synthetic oligonucleotide
gggacacaattaaggtgttttacacgcaactggttc

SEQ ID NO: 412676 - DNA, 39 bp, Artificial Sequence
  Description of Artificial Sequence: Synthetic oligonucleotide
ggacacaattaaggtgttttacacgcaactggttcaaac

SEQ ID NO: 412677 - DNA, 39 bp, Artificial Sequence
  Description of Artificial Sequence: Synthetic oligonucleotide
gacacaattaaggtgttttacacgcaactggttcaaacc

SEQ ID NO: 412678 - DNA, 42 bp, Artificial Sequence
  Description of Artificial Sequence: Synthetic oligonucleotide
acacaattaaggtgttttacacgcaactggttcaaacctttc

SEQ ID NO: 412679 - DNA, 41 bp, Artificial Sequence
  Description of Artificial Sequence: Synthetic oligonucleotide
cacaattaaggtgttttacacgcaactggttcaaacctttc

SEQ ID NO: 412680 - DNA, 43 bp, Artificial Sequence
  Description of Artificial Sequence: Synthetic oligonucleotide
acaattaaggtgttttacacgcaactggttcaaacctttcaag

SEQ ID NO: 412681 - DNA, 42 bp, Artificial Sequence
  Description of Artificial Sequence: Synthetic oligonucleotide
caattaaggtgttttacacgcaactggttcaaacctttcaag

SEQ ID NO: 412682 - DNA, 44 bp, Artificial Sequence
  Description of Artificial Sequence: Synthetic oligonucleotide
aattaaggtgttttacacgcaactggttcaaacctttcaagtac

SEQ ID NO: 412683 - DNA, 43 bp, Artificial Sequence
  Description of Artificial Sequence: Synthetic oligonucleotide
attaaggtgttttacacgcaactggttcaaacctttcaagtac

SEQ ID NO: 412684 - DNA, 42 bp, Artificial Sequence
  Description of Artificial Sequence: Synthetic oligonucleotide
ttaaggtgttttacacgcaactggttcaaacctttcaagtac

SEQ ID NO: 412685 - DNA, 41 bp, Artificial Sequence
  Description of Artificial Sequence: Synthetic oligonucleotide
taaggtgttttacacgcaactggttcaaacctttcaagtac

SEQ ID NO: 412686 - DNA, 40 bp, Artificial Sequence
  Description of Artificial Sequence: Synthetic oligonucleotide
aaggtgttttacacgcaactggttcaaacctttcaagtac

SEQ ID NO: 412687 - DNA, 39 bp, Artificial Sequence
  Description of Artificial Sequence: Synthetic oligonucleotide
aggtgttttacacgcaactggttcaaacctttcaagtac

SEQ ID NO: 412688 - DNA, 38 bp, Artificial Sequence
  Description of Artificial Sequence: Synthetic oligonucleotide
ggtgttttacacgcaactggttcaaacctttcaagtac

SEQ ID NO: 412689 - DNA, 48 bp, Artificial Sequence
  Description of Artificial Sequence: Synthetic oligonucleotide
gtgttttacacgcaactggttcaaacctttcaagtactaaattaaaac

SEQ ID NO: 412690 - DNA, 51 bp, Artificial Sequence
  Description of Artificial Sequence: Synthetic oligonucleotide
tgttttacacgcaactggttcaaacctttcaagtactaaattaaaacaatc

SEQ ID NO: 412691 - DNA, 50 bp, Artificial Sequence
  Description of Artificial Sequence: Synthetic oligonucleotide
gttttacacgcaactggttcaaacctttcaagtactaaattaaaacaatc

SEQ ID NO: 412692 - DNA, 50 bp, Artificial Sequence
  Description of Artificial Sequence: Synthetic oligonucleotide
ttttacacgcaactggttcaaacctttcaagtactaaattaaaacaatcc

SEQ ID NO: 412693 - DNA, 49 bp, Artificial Sequence
  Description of Artificial Sequence: Synthetic oligonucleotide
tttacacgcaactggttcaaacctttcaagtactaaattaaaacaatcc

SEQ ID NO: 412694 - DNA, 48 bp, Artificial Sequence
  Description of Artificial Sequence: Synthetic oligonucleotide
ttacacgcaactggttcaaacctttcaagtactaaattaaaacaatcc

SEQ ID NO: 412695 - DNA, 47 bp, Artificial Sequence
  Description of Artificial Sequence: Synthetic oligonucleotide
tacacgcaactggttcaaacctttcaagtactaaattaaaacaatcc

SEQ ID NO: 412696 - DNA, 46 bp, Artificial Sequence
  Description of Artificial Sequence: Synthetic oligonucleotide
acacgcaactggttcaaacctttcaagtactaaattaaaacaatcc

SEQ ID NO: 412697 - DNA, 45 bp, Artificial Sequence
  Description of Artificial Sequence: Synthetic oligonucleotide
cacgcaactggttcaaacctttcaagtactaaattaaaacaatcc

SEQ ID NO: 412698 - DNA, 51 bp, Artificial Sequence
  Description of Artificial Sequence: Synthetic oligonucleotide
acgcaactggttcaaacctttcaagtactaaattaaaacaatcctttaaag

SEQ ID NO: 412699 - DNA, 50 bp, Artificial Sequence
  Description of Artificial Sequence: Synthetic oligonucleotide
cgcaactggttcaaacctttcaagtactaaattaaaacaatcctttaaag

SEQ ID NO: 412700 - DNA, 52 bp, Artificial Sequence
  Description of Artificial Sequence: Synthetic oligonucleotide
gcaactggttcaaacctttcaagtactaaattaaaacaatcctttaaagaag

SEQ ID NO: 412701 - DNA, 52 bp, Artificial Sequence
  Description of Artificial Sequence: Synthetic oligonucleotide
caactggttcaaacctttcaagtactaaattaaaacaatcctttaaagaagg

SEQ ID NO: 412702 - DNA, 57 bp, Artificial Sequence
  Description of Artificial Sequence: Synthetic oligonucleotide
aactggttcaaacctttcaagtactaaattaaaacaatcctttaaagaaggaaattg

SEQ ID NO: 412703 - DNA, 56 bp, Artificial Sequence
  Description of Artificial Sequence: Synthetic oligonucleotide
actggttcaaacctttcaagtactaaattaaaacaatcctttaaagaaggaaattg

SEQ ID NO: 412704 - DNA, 55 bp, Artificial Sequence
  Description of Artificial Sequence: Synthetic oligonucleotide
ctggttcaaacctttcaagtactaaattaaaacaatcctttaaagaaggaaattg

SEQ ID NO: 412705 - DNA, 58 bp, Artificial Sequence
  Description of Artificial Sequence: Synthetic oligonucleotide
tggttcaaacctttcaagtactaaattaaaacaatcctttaaagaaggaaattgtttc

SEQ ID NO: 412706 - DNA, 57 bp, Artificial Sequence
  Description of Artificial Sequence: Synthetic oligonucleotide
ggttcaaacctttcaagtactaaattaaaacaatcctttaaagaaggaaattgtttc

SEQ ID NO: 412707 - DNA, 58 bp, Artificial Sequence
  Description of Artificial Sequence: Synthetic oligonucleotide
gttcaaacctttcaagtactaaattaaaacaatcctttaaagaaggaaattgtttcag

SEQ ID NO: 412708 - DNA, 60 bp, Artificial Sequence
  Description of Artificial Sequence: Synthetic oligonucleotide
ttcaaacctttcaagtactaaattaaaacaatcctttaaagaaggaaattgtttcagaaa

SEQ ID NO: 412709 - DNA, 60 bp, Artificial Sequence
  Description of Artificial Sequence: Synthetic oligonucleotide
tcaaacctttcaagtactaaattaaaacaatcctttaaagaaggaaattgtttcagaaaa

SEQ ID NO: 412710 - DNA, 60 bp, Artificial Sequence
  Description of Artificial Sequence: Synthetic oligonucleotide
caaacctttcaagtactaaattaaaacaatcctttaaagaaggaaattgtttcagaaaag

SEQ ID NO: 412711 - DNA, 60 bp, Artificial Sequence
  Description of Artificial Sequence: Synthetic oligonucleotide
aaacctttcaagtactaaattaaaacaatcctttaaagaaggaaattgtttcagaaaagg

SEQ ID NO: 412712 - DNA, 59 bp, Artificial Sequence
  Description of Artificial Sequence: Synthetic oligonucleotide
aacctttcaagtactaaattaaaacaatcctttaaagaaggaaattgtttcagaaaagg

SEQ ID NO: 412713 - DNA, 58 bp, Artificial Sequence
  Description of Artificial Sequence: Synthetic oligonucleotide
acctttcaagtactaaattaaaacaatcctttaaagaaggaaattgtttcagaaaagg

SEQ ID NO: 412714 - DNA, 57 bp, Artificial Sequence
  Description of Artificial Sequence: Synthetic oligonucleotide
cctttcaagtactaaattaaaacaatcctttaaagaaggaaattgtttcagaaaagg

SEQ ID NO: 412715 - DNA, 58 bp, Artificial Sequence
  Description of Artificial Sequence: Synthetic oligonucleotide
ctttcaagtactaaattaaaacaatcctttaaagaaggaaattgtttcagaaaaggac

SEQ ID NO: 412716 - DNA, 58 bp, Artificial Sequence
  Description of Artificial Sequence: Synthetic oligonucleotide
tttcaagtactaaattaaaacaatcctttaaagaaggaaattgtttcagaaaaggacc

SEQ ID NO: 412717 - DNA, 57 bp, Artificial Sequence
  Description of Artificial Sequence: Synthetic oligonucleotide
ttcaagtactaaattaaaacaatcctttaaagaaggaaattgtttcagaaaaggacc

SEQ ID NO: 412718 - DNA, 56 bp, Artificial Sequence
  Description of Artificial Sequence: Synthetic oligonucleotide
tcaagtactaaattaaaacaatcctttaaagaaggaaattgtttcagaaaaggacc

SEQ ID NO: 412719 - DNA, 55 bp, Artificial Sequence
  Description of Artificial Sequence: Synthetic oligonucleotide
caagtactaaattaaaacaatcctttaaagaaggaaattgtttcagaaaaggacc

SEQ ID NO: 412720 - DNA, 57 bp, Artificial Sequence
  Description of Artificial Sequence: Synthetic oligonucleotide
aagtactaaattaaaacaatcctttaaagaaggaaattgtttcagaaaaggaccttc

SEQ ID NO: 412721 - DNA, 56 bp, Artificial Sequence
  Description of Artificial Sequence: Synthetic oligonucleotide
agtactaaattaaaacaatcctttaaagaaggaaattgtttcagaaaaggaccttc

SEQ ID NO: 412722 - DNA, 55 bp, Artificial Sequence
  Description of Artificial Sequence: Synthetic oligonucleotide
gtactaaattaaaacaatcctttaaagaaggaaattgtttcagaaaaggaccttc

SEQ ID NO: 412723 - DNA, 58 bp, Artificial Sequence
  Description of Artificial Sequence: Synthetic oligonucleotide
tactaaattaaaacaatcctttaaagaaggaaattgtttcagaaaaggaccttcatac

SEQ ID NO: 412724 - DNA, 57 bp, Artificial Sequence
  Description of Artificial Sequence: Synthetic oligonucleotide
actaaattaaaacaatcctttaaagaaggaaattgtttcagaaaaggaccttcatac

SEQ ID NO: 412725 - DNA, 56 bp, Artificial Sequence
  Description of Artificial Sequence: Synthetic oligonucleotide
ctaaattaaaacaatcctttaaagaaggaaattgtttcagaaaaggaccttcatac

SEQ ID NO: 412726 - DNA, 57 bp, Artificial Sequence
  Description of Artificial Sequence: Synthetic oligonucleotide
taaattaaaacaatcctttaaagaaggaaattgtttcagaaaaggaccttcatacag

SEQ ID NO: 412727 - DNA, 56 bp, Artificial Sequence
  Description of Artificial Sequence: Synthetic oligonucleotide
aaattaaaacaatcctttaaagaaggaaattgtttcagaaaaggaccttcatacag

SEQ ID NO: 412728 - DNA, 55 bp, Artificial Sequence
  Description of Artificial Sequence: Synthetic oligonucleotide
aattaaaacaatcctttaaagaaggaaattgtttcagaaaaggaccttcatacag

SEQ ID NO: 412729 - DNA, 54 bp, Artificial Sequence
  Description of Artificial Sequence: Synthetic oligonucleotide
attaaaacaatcctttaaagaaggaaattgtttcagaaaaggaccttcatacag

SEQ ID NO: 412730 - DNA, 53 bp, Artificial Sequence
  Description of Artificial Sequence: Synthetic oligonucleotide
ttaaaacaatcctttaaagaaggaaattgtttcagaaaaggaccttcatacag

SEQ ID NO: 412731 - DNA, 52 bp, Artificial Sequence
  Description of Artificial Sequence: Synthetic oligonucleotide
taaaacaatcctttaaagaaggaaattgtttcagaaaaggaccttcatacag

SEQ ID NO: 412732 - DNA, 51 bp, Artificial Sequence
  Description of Artificial Sequence: Synthetic oligonucleotide
aaaacaatcctttaaagaaggaaattgtttcagaaaaggaccttcatacag

SEQ ID NO: 412733 - DNA, 50 bp, Artificial Sequence
  Description of Artificial Sequence: Synthetic oligonucleotide
aaacaatcctttaaagaaggaaattgtttcagaaaaggaccttcatacag

SEQ ID NO: 412734 - DNA, 49 bp, Artificial Sequence
  Description of Artificial Sequence: Synthetic oligonucleotide
aacaatcctttaaagaaggaaattgtttcagaaaaggaccttcatacag

SEQ ID NO: 412735 - DNA, 48 bp, Artificial Sequence
  Description of Artificial Sequence: Synthetic oligonucleotide
acaatcctttaaagaaggaaattgtttcagaaaaggaccttcatacag

SEQ ID NO: 412736 - DNA, 47 bp, Artificial Sequence
  Description of Artificial Sequence: Synthetic oligonucleotide
caatcctttaaagaaggaaattgtttcagaaaaggaccttcatacag

SEQ ID NO: 412737 - DNA, 47 bp, Artificial Sequence
  Description of Artificial Sequence: Synthetic oligonucleotide
aatcctttaaagaaggaaattgtttcagaaaaggaccttcatacagc

SEQ ID NO: 412738 - DNA, 46 bp, Artificial Sequence
  Description of Artificial Sequence: Synthetic oligonucleotide
atcctttaaagaaggaaattgtttcagaaaaggaccttcatacagc

SEQ ID NO: 412739 - DNA, 45 bp, Artificial Sequence
  Description of Artificial Sequence: Synthetic oligonucleotide
tcctttaaagaaggaaattgtttcagaaaaggaccttcatacagc

SEQ ID NO: 412740 - DNA, 44 bp, Artificial Sequence
  Description of Artificial Sequence: Synthetic oligonucleotide
cctttaaagaaggaaattgtttcagaaaaggaccttcatacagc

SEQ ID NO: 412741 - DNA, 46 bp, Artificial Sequence
  Description of Artificial Sequence: Synthetic oligonucleotide
ctttaaagaaggaaattgtttcagaaaaggaccttcatacagcatc

SEQ ID NO: 412742 - DNA, 47 bp, Artificial Sequence
  Description of Artificial Sequence: Synthetic oligonucleotide
tttaaagaaggaaattgtttcagaaaaggaccttcatacagcatctc

SEQ ID NO: 412743 - DNA, 46 bp, Artificial Sequence
  Description of Artificial Sequence: Synthetic oligonucleotide
ttaaagaaggaaattgtttcagaaaaggaccttcatacagcatctc

SEQ ID NO: 412744 - DNA, 45 bp, Artificial Sequence
  Description of Artificial Sequence: Synthetic oligonucleotide
taaagaaggaaattgtttcagaaaaggaccttcatacagcatctc

SEQ ID NO: 412745 - DNA, 44 bp, Artificial Sequence
  Description of Artificial Sequence: Synthetic oligonucleotide
aaagaaggaaattgtttcagaaaaggaccttcatacagcatctc

SEQ ID NO: 412746 - DNA, 43 bp, Artificial Sequence
  Description of Artificial Sequence: Synthetic oligonucleotide
aagaaggaaattgtttcagaaaaggaccttcatacagcatctc

SEQ ID NO: 412747 - DNA, 42 bp, Artificial Sequence
  Description of Artificial Sequence: Synthetic oligonucleotide
agaaggaaattgtttcagaaaaggaccttcatacagcatctc

SEQ ID NO: 412748 - DNA, 41 bp, Artificial Sequence
  Description of Artificial Sequence: Synthetic oligonucleotide
gaaggaaattgtttcagaaaaggaccttcatacagcatctc

SEQ ID NO: 412749 - DNA, 42 bp, Artificial Sequence
  Description of Artificial Sequence: Synthetic oligonucleotide
aaggaaattgtttcagaaaaggaccttcatacagcatctctg

SEQ ID NO: 412750 - DNA, 41 bp, Artificial Sequence
  Description of Artificial Sequence: Synthetic oligonucleotide
aggaaattgtttcagaaaaggaccttcatacagcatctctg

SEQ ID NO: 412751 - DNA, 40 bp, Artificial Sequence
  Description of Artificial Sequence: Synthetic oligonucleotide
ggaaattgtttcagaaaaggaccttcatacagcatctctg

SEQ ID NO: 412752 - DNA, 41 bp, Artificial Sequence
  Description of Artificial Sequence: Synthetic oligonucleotide
gaaattgtttcagaaaaggaccttcatacagcatctctgac

SEQ ID NO: 412753 - DNA, 41 bp, Artificial Sequence
  Description of Artificial Sequence: Synthetic oligonucleotide
aaattgtttcagaaaaggaccttcatacagcatctctgacc

SEQ ID NO: 412754 - DNA, 40 bp, Artificial Sequence
  Description of Artificial Sequence: Synthetic oligonucleotide
aattgtttcagaaaaggaccttcatacagcatctctgacc

SEQ ID NO: 412755 - DNA, 39 bp, Artificial Sequence
  Description of Artificial Sequence: Synthetic oligonucleotide
attgtttcagaaaaggaccttcatacagcatctctgacc

SEQ ID NO: 412756 - DNA, 38 bp, Artificial Sequence
  Description of Artificial Sequence: Synthetic oligonucleotide
ttgtttcagaaaaggaccttcatacagcatctctgacc

SEQ ID NO: 412757 - DNA, 37 bp, Artificial Sequence
  Description of Artificial Sequence: Synthetic oligonucleotide
tgtttcagaaaaggaccttcatacagcatctctgacc

SEQ ID NO: 412758 - DNA, 36 bp, Artificial Sequence
  Description of Artificial Sequence: Synthetic oligonucleotide
gtttcagaaaaggaccttcatacagcatctctgacc

SEQ ID NO: 412759 - DNA, 37 bp, Artificial Sequence
  Description of Artificial Sequence: Synthetic oligonucleotide
tttcagaaaaggaccttcatacagcatctctgaccag

SEQ ID NO: 412760 - DNA, 36 bp, Artificial Sequence
  Description of Artificial Sequence: Synthetic oligonucleotide
ttcagaaaaggaccttcatacagcatctctgaccag

SEQ ID NO: 412761 - DNA, 35 bp, Artificial Sequence
  Description of Artificial Sequence: Synthetic oligonucleotide
tcagaaaaggaccttcatacagcatctctgaccag

SEQ ID NO: 412762 - DNA, 34 bp, Artificial Sequence
  Description of Artificial Sequence: Synthetic oligonucleotide
cagaaaaggaccttcatacagcatctctgaccag

SEQ ID NO: 412763 - DNA, 34 bp, Artificial Sequence
  Description of Artificial Sequence: Synthetic oligonucleotide
agaaaaggaccttcatacagcatctctgaccagc

SEQ ID NO: 412764 - DNA, 33 bp, Artificial Sequence
  Description of Artificial Sequence: Synthetic oligonucleotide
gaaaaggaccttcatacagcatctctgaccagc

SEQ ID NO: 412765 - DNA, 33 bp, Artificial Sequence
  Description of Artificial Sequence: Synthetic oligonucleotide
aaaaggaccttcatacagcatctctgaccagcg

SEQ ID NO: 412766 - DNA, 32 bp, Artificial Sequence
  Description of Artificial Sequence: Synthetic oligonucleotide
aaaggaccttcatacagcatctctgaccagcg

SEQ ID NO: 412767 - DNA, 31 bp, Artificial Sequence
  Description of Artificial Sequence: Synthetic oligonucleotide
aaggaccttcatacagcatctctgaccagcg

SEQ ID NO: 412768 - DNA, 30 bp, Artificial Sequence
  Description of Artificial Sequence: Synthetic oligonucleotide
aggaccttcatacagcatctctgaccagcg

SEQ ID NO: 412769 - DNA, 29 bp, Artificial Sequence
  Description of Artificial Sequence: Synthetic oligonucleotide
ggaccttcatacagcatctctgaccagcg

SEQ ID NO: 412770 - DNA, 30 bp, Artificial Sequence
  Description of Artificial Sequence: Synthetic oligonucleotide
gaccttcatacagcatctctgaccagcgac

SEQ ID NO: 412771 - DNA, 31 bp, Artificial Sequence
  Description of Artificial Sequence: Synthetic oligonucleotide
accttcatacagcatctctgaccagcgactg

SEQ ID NO: 412772 - DNA, 30 bp, Artificial Sequence
  Description of Artificial Sequence: Synthetic oligonucleotide
ccttcatacagcatctctgaccagcgactg

SEQ ID NO: 412773 - DNA, 32 bp, Artificial Sequence
  Description of Artificial Sequence: Synthetic oligonucleotide
cttcatacagcatctctgaccagcgactgatg

SEQ ID NO: 412774 - DNA, 34 bp, Artificial Sequence
  Description of Artificial Sequence: Synthetic oligonucleotide
ttcatacagcatctctgaccagcgactgatgatg

SEQ ID NO: 412775 - DNA, 33 bp, Artificial Sequence
  Description of Artificial Sequence: Synthetic oligonucleotide
tcatacagcatctctgaccagcgactgatgatg

SEQ ID NO: 412776 - DNA, 32 bp, Artificial Sequence
  Description of Artificial Sequence: Synthetic oligonucleotide
catacagcatctctgaccagcgactgatgatg

SEQ ID NO: 412777 - DNA, 32 bp, Artificial Sequence
  Description of Artificial Sequence: Synthetic oligonucleotide
atacagcatctctgaccagcgactgatgatgc

SEQ ID NO: 412778 - DNA, 31 bp, Artificial Sequence
  Description of Artificial Sequence: Synthetic oligonucleotide
tacagcatctctgaccagcgactgatgatgc

SEQ ID NO: 412779 - DNA, 30 bp, Artificial Sequence
  Description of Artificial Sequence: Synthetic oligonucleotide
acagcatctctgaccagcgactgatgatgc

SEQ ID NO: 412780 - DNA, 29 bp, Artificial Sequence
  Description of Artificial Sequence: Synthetic oligonucleotide
cagcatctctgaccagcgactgatgatgc

SEQ ID NO: 412781 - DNA, 33 bp, Artificial Sequence
  Description of Artificial Sequence: Synthetic oligonucleotide
agcatctctgaccagcgactgatgatgctattg

SEQ ID NO: 412782 - DNA, 32 bp, Artificial Sequence
  Description of Artificial Sequence: Synthetic oligonucleotide
gcatctctgaccagcgactgatgatgctattg

SEQ ID NO: 412783 - DNA, 34 bp, Artificial Sequence
  Description of Artificial Sequence: Synthetic oligonucleotide
catctctgaccagcgactgatgatgctattgtac

SEQ ID NO: 412784 - DNA, 35 bp, Artificial Sequence
  Description of Artificial Sequence: Synthetic oligonucleotide
atctctgaccagcgactgatgatgctattgtactc

SEQ ID NO: 412785 - DNA, 34 bp, Artificial Sequence
  Description of Artificial Sequence: Synthetic oligonucleotide
tctctgaccagcgactgatgatgctattgtactc

SEQ ID NO: 412786 - DNA, 33 bp, Artificial Sequence
  Description of Artificial Sequence: Synthetic oligonucleotide
ctctgaccagcgactgatgatgctattgtactc

SEQ ID NO: 412787 - DNA, 34 bp, Artificial Sequence
  Description of Artificial Sequence: Synthetic oligonucleotide
tctgaccagcgactgatgatgctattgtactcag

SEQ ID NO: 412788 - DNA, 33 bp, Artificial Sequence
  Description of Artificial Sequence: Synthetic oligonucleotide
ctgaccagcgactgatgatgctattgtactcag

SEQ ID NO: 412789 - DNA, 35 bp, Artificial Sequence
  Description of Artificial Sequence: Synthetic oligonucleotide
tgaccagcgactgatgatgctattgtactcagatg

SEQ ID NO: 412790 - DNA, 34 bp, Artificial Sequence
  Description of Artificial Sequence: Synthetic oligonucleotide
gaccagcgactgatgatgctattgtactcagatg

SEQ ID NO: 412791 - DNA, 34 bp, Artificial Sequence
  Description of Artificial Sequence: Synthetic oligonucleotide
accagcgactgatgatgctattgtactcagatgc

SEQ ID NO: 412792 - DNA, 33 bp, Artificial Sequence
  Description of Artificial Sequence: Synthetic oligonucleotide
ccagcgactgatgatgctattgtactcagatgc

SEQ ID NO: 412793 - DNA, 34 bp, Artificial Sequence
  Description of Artificial Sequence: Synthetic oligonucleotide
cagcgactgatgatgctattgtactcagatgctg

SEQ ID NO: 412794 - DNA, 37 bp, Artificial Sequence
  Description of Artificial Sequence: Synthetic oligonucleotide
agcgactgatgatgctattgtactcagatgctgattc

SEQ ID NO: 412795 - DNA, 36 bp, Artificial Sequence
  Description of Artificial Sequence: Synthetic oligonucleotide
gcgactgatgatgctattgtactcagatgctgattc

SEQ ID NO: 412796 - DNA, 36 bp, Artificial Sequence
  Description of Artificial Sequence: Synthetic oligonucleotide
cgactgatgatgctattgtactcagatgctgattcg

SEQ ID NO: 412797 - DNA, 38 bp, Artificial Sequence
  Description of Artificial Sequence: Synthetic oligonucleotide
gactgatgatgctattgtactcagatgctgattcgttc

SEQ ID NO: 412798 - DNA, 39 bp, Artificial Sequence
  Description of Artificial Sequence: Synthetic oligonucleotide
actgatgatgctattgtactcagatgctgattcgttctc

SEQ ID NO: 412799 - DNA, 38 bp, Artificial Sequence
  Description of Artificial Sequence: Synthetic oligonucleotide
ctgatgatgctattgtactcagatgctgattcgttctc

SEQ ID NO: 412800 - DNA, 38 bp, Artificial Sequence
  Description of Artificial Sequence: Synthetic oligonucleotide
tgatgatgctattgtactcagatgctgattcgttctcc

SEQ ID NO: 412801 - DNA, 37 bp, Artificial Sequence
  Description of Artificial Sequence: Synthetic oligonucleotide
gatgatgctattgtactcagatgctgattcgttctcc

SEQ ID NO: 412802 - DNA, 39 bp, Artificial Sequence
  Description of Artificial Sequence: Synthetic oligonucleotide
atgatgctattgtactcagatgctgattcgttctccaac

SEQ ID NO: 412803 - DNA, 38 bp, Artificial Sequence
  Description of Artificial Sequence: Synthetic oligonucleotide
tgatgctattgtactcagatgctgattcgttctccaac

SEQ ID NO: 412804 - DNA, 37 bp, Artificial Sequence
  Description of Artificial Sequence: Synthetic oligonucleotide
gatgctattgtactcagatgctgattcgttctccaac

SEQ ID NO: 412805 - DNA, 38 bp, Artificial Sequence
  Description of Artificial Sequence: Synthetic oligonucleotide
atgctattgtactcagatgctgattcgttctccaacac

SEQ ID NO: 412806 - DNA, 37 bp, Artificial Sequence
  Description of Artificial Sequence: Synthetic oligonucleotide
tgctattgtactcagatgctgattcgttctccaacac

SEQ ID NO: 412807 - DNA, 36 bp, Artificial Sequence
  Description of Artificial Sequence: Synthetic oligonucleotide
gctattgtactcagatgctgattcgttctccaacac

SEQ ID NO: 412808 - DNA, 38 bp, Artificial Sequence
  Description of Artificial Sequence: Synthetic oligonucleotide
ctattgtactcagatgctgattcgttctccaacactag

SEQ ID NO: 412809 - DNA, 42 bp, Artificial Sequence
  Description of Artificial Sequence: Synthetic oligonucleotide
tattgtactcagatgctgattcgttctccaacactagattac

SEQ ID NO: 412810 - DNA, 41 bp, Artificial Sequence
  Description of Artificial Sequence: Synthetic oligonucleotide
attgtactcagatgctgattcgttctccaacactagattac

SEQ ID NO: 412811 - DNA, 40 bp, Artificial Sequence
  Description of Artificial Sequence: Synthetic oligonucleotide
ttgtactcagatgctgattcgttctccaacactagattac

SEQ ID NO: 412812 - DNA, 39 bp, Artificial Sequence
  Description of Artificial Sequence: Synthetic oligonucleotide
tgtactcagatgctgattcgttctccaacactagattac

SEQ ID NO: 412813 - DNA, 38 bp, Artificial Sequence
  Description of Artificial Sequence: Synthetic oligonucleotide
gtactcagatgctgattcgttctccaacactagattac

SEQ ID NO: 412814 - DNA, 38 bp, Artificial Sequence
  Description of Artificial Sequence: Synthetic oligonucleotide
tactcagatgctgattcgttctccaacactagattacc

SEQ ID NO: 412815 - DNA, 36 bp, Artificial Sequence
  Description of Artificial Sequence: Synthetic oligonucleotide
ctgattcgttctccaacactagattacccaatccac

SEQ ID NO: 412816 - DNA, 36 bp, Artificial Sequence
  Description of Artificial Sequence: Synthetic oligonucleotide
tgattcgttctccaacactagattacccaatccacg

SEQ ID NO: 412817 - DNA, 35 bp, Artificial Sequence
  Description of Artificial Sequence: Synthetic oligonucleotide
gattcgttctccaacactagattacccaatccacg

SEQ ID NO: 412818 - DNA, 36 bp, Artificial Sequence
  Description of Artificial Sequence: Synthetic oligonucleotide
attcgttctccaacactagattacccaatccacgag

SEQ ID NO: 412819 - DNA, 35 bp, Artificial Sequence
  Description of Artificial Sequence: Synthetic oligonucleotide
ttcgttctccaacactagattacccaatccacgag

SEQ ID NO: 412820 - DNA, 34 bp, Artificial Sequence
  Description of Artificial Sequence: Synthetic oligonucleotide
tcgttctccaacactagattacccaatccacgag

SEQ ID NO: 412821 - DNA, 33 bp, Artificial Sequence
  Description of Artificial Sequence: Synthetic oligonucleotide
cgttctccaacactagattacccaatccacgag

SEQ ID NO: 412822 - DNA, 33 bp, Artificial Sequence
  Description of Artificial Sequence: Synthetic oligonucleotide
gttctccaacactagattacccaatccacgagc

SEQ ID NO: 412823 - DNA, 35 bp, Artificial Sequence
  Description of Artificial Sequence: Synthetic oligonucleotide
ttctccaacactagattacccaatccacgagcaag

SEQ ID NO: 412824 - DNA, 34 bp, Artificial Sequence
  Description of Artificial Sequence: Synthetic oligonucleotide
tctccaacactagattacccaatccacgagcaag

SEQ ID NO: 412825 - DNA, 33 bp, Artificial Sequence
  Description of Artificial Sequence: Synthetic oligonucleotide
ctccaacactagattacccaatccacgagcaag

SEQ ID NO: 412826 - DNA, 33 bp, Artificial Sequence
  Description of Artificial Sequence: Synthetic oligonucleotide
tccaacactagattacccaatccacgagcaagg

SEQ ID NO: 412827 - DNA, 32 bp, Artificial Sequence
  Description of Artificial Sequence: Synthetic oligonucleotide
ccaacactagattacccaatccacgagcaagg

SEQ ID NO: 412828 - DNA, 36 bp, Artificial Sequence
  Description of Artificial Sequence: Synthetic oligonucleotide
caacactagattacccaatccacgagcaaggaaatc

SEQ ID NO: 412829 - DNA, 37 bp, Artificial Sequence
  Description of Artificial Sequence: Synthetic oligonucleotide
aacactagattacccaatccacgagcaaggaaatcag

SEQ ID NO: 412830 - DNA, 36 bp, Artificial Sequence
  Description of Artificial Sequence: Synthetic oligonucleotide
acactagattacccaatccacgagcaaggaaatcag

SEQ ID NO: 412831 - DNA, 35 bp, Artificial Sequence
  Description of Artificial Sequence: Synthetic oligonucleotide
cactagattacccaatccacgagcaaggaaatcag

SEQ ID NO: 412832 - DNA, 38 bp, Artificial Sequence
  Description of Artificial Sequence: Synthetic oligonucleotide
actagattacccaatccacgagcaaggaaatcagtaac

SEQ ID NO: 412833 - DNA, 37 bp, Artificial Sequence
  Description of Artificial Sequence: Synthetic oligonucleotide
ctagattacccaatccacgagcaaggaaatcagtaac

SEQ ID NO: 412834 - DNA, 39 bp, Artificial Sequence
  Description of Artificial Sequence: Synthetic oligonucleotide
tagattacccaatccacgagcaaggaaatcagtaacttc

SEQ ID NO: 412835 - DNA, 38 bp, Artificial Sequence
  Description of Artificial Sequence: Synthetic oligonucleotide
agattacccaatccacgagcaaggaaatcagtaacttc

SEQ ID NO: 412836 - DNA, 37 bp, Artificial Sequence
  Description of Artificial Sequence: Synthetic oligonucleotide
gattacccaatccacgagcaaggaaatcagtaacttc

SEQ ID NO: 412837 - DNA, 39 bp, Artificial Sequence
  Description of Artificial Sequence: Synthetic oligonucleotide
attacccaatccacgagcaaggaaatcagtaacttcttc

SEQ ID NO: 412838 - DNA, 38 bp, Artificial Sequence
  Description of Artificial Sequence: Synthetic oligonucleotide
ttacccaatccacgagcaaggaaatcagtaacttcttc

SEQ ID NO: 412839 - DNA, 37 bp, Artificial Sequence
  Description of Artificial Sequence: Synthetic oligonucleotide
tacccaatccacgagcaaggaaatcagtaacttcttc

SEQ ID NO: 412840 - DNA, 36 bp, Artificial Sequence
  Description of Artificial Sequence: Synthetic oligonucleotide
acccaatccacgagcaaggaaatcagtaacttcttc

SEQ ID NO: 412841 - DNA, 35 bp, Artificial Sequence
  Description of Artificial Sequence: Synthetic oligonucleotide
cccaatccacgagcaaggaaatcagtaacttcttc

SEQ ID NO: 412842 - DNA, 35 bp, Artificial Sequence
  Description of Artificial Sequence: Synthetic oligonucleotide
ccaatccacgagcaaggaaatcagtaacttcttcc

SEQ ID NO: 412843 - DNA, 35 bp, Artificial Sequence
  Description of Artificial Sequence: Synthetic oligonucleotide
caatccacgagcaaggaaatcagtaacttcttccc

SEQ ID NO: 412844 - DNA, 43 bp, Artificial Sequence
  Description of Artificial Sequence: Synthetic oligonucleotide
aatccacgagcaaggaaatcagtaacttcttccctataatttg

SEQ ID NO: 412845 - DNA, 42 bp, Artificial Sequence
  Description of Artificial Sequence: Synthetic oligonucleotide
atccacgagcaaggaaatcagtaacttcttccctataatttg

SEQ ID NO: 412846 - DNA, 41 bp, Artificial Sequence
  Description of Artificial Sequence: Synthetic oligonucleotide
tccacgagcaaggaaatcagtaacttcttccctataatttg

SEQ ID NO: 412847 - DNA, 40 bp, Artificial Sequence
  Description of Artificial Sequence: Synthetic oligonucleotide
ccacgagcaaggaaatcagtaacttcttccctataatttg

SEQ ID NO: 412848 - DNA, 40 bp, Artificial Sequence
  Description of Artificial Sequence: Synthetic oligonucleotide
cacgagcaaggaaatcagtaacttcttccctataatttgg

SEQ ID NO: 412849 - DNA, 43 bp, Artificial Sequence
  Description of Artificial Sequence: Synthetic oligonucleotide
acgagcaaggaaatcagtaacttcttccctataatttggaatg

SEQ ID NO: 412850 - DNA, 42 bp, Artificial Sequence
  Description of Artificial Sequence: Synthetic oligonucleotide
cgagcaaggaaatcagtaacttcttccctataatttggaatg

SEQ ID NO: 412851 - DNA, 43 bp, Artificial Sequence
  Description of Artificial Sequence: Synthetic oligonucleotide
gagcaaggaaatcagtaacttcttccctataatttggaatgtg

SEQ ID NO: 412852 - DNA, 43 bp, Artificial Sequence
  Description of Artificial Sequence: Synthetic oligonucleotide
agcaaggaaatcagtaacttcttccctataatttggaatgtgg

SEQ ID NO: 412853 - DNA, 42 bp, Artificial Sequence
  Description of Artificial Sequence: Synthetic oligonucleotide
gcaaggaaatcagtaacttcttccctataatttggaatgtgg

SEQ ID NO: 412854 - DNA, 42 bp, Artificial Sequence
  Description of Artificial Sequence: Synthetic oligonucleotide
caaggaaatcagtaacttcttccctataatttggaatgtggg

SEQ ID NO: 412855 - DNA, 43 bp, Artificial Sequence
  Description of Artificial Sequence: Synthetic oligonucleotide
aaggaaatcagtaacttcttccctataatttggaatgtgggtg

SEQ ID NO: 412856 - DNA, 42 bp, Artificial Sequence
  Description of Artificial Sequence: Synthetic oligonucleotide
aggaaatcagtaacttcttccctataatttggaatgtgggtg

SEQ ID NO: 412857 - DNA, 41 bp, Artificial Sequence
  Description of Artificial Sequence: Synthetic oligonucleotide
ggaaatcagtaacttcttccctataatttggaatgtgggtg

SEQ ID NO: 412858 - DNA, 41 bp, Artificial Sequence
  Description of Artificial Sequence: Synthetic oligonucleotide
gaaatcagtaacttcttccctataatttggaatgtgggtgg

SEQ ID NO: 412859 - DNA, 42 bp, Artificial Sequence
  Description of Artificial Sequence: Synthetic oligonucleotide
aaatcagtaacttcttccctataatttggaatgtgggtggag

SEQ ID NO: 412860 - DNA, 41 bp, Artificial Sequence
  Description of Artificial Sequence: Synthetic oligonucleotide
aatcagtaacttcttccctataatttggaatgtgggtggag

SEQ ID NO: 412861 - DNA, 40 bp, Artificial Sequence
  Description of Artificial Sequence: Synthetic oligonucleotide
atcagtaacttcttccctataatttggaatgtgggtggag

SEQ ID NO: 412862 - DNA, 39 bp, Artificial Sequence
  Description of Artificial Sequence: Synthetic oligonucleotide
tcagtaacttcttccctataatttggaatgtgggtggag

SEQ ID NO: 412863 - DNA, 38 bp, Artificial Sequence
  Description of Artificial Sequence: Synthetic oligonucleotide
cagtaacttcttccctataatttggaatgtgggtggag

SEQ ID NO: 412864 - DNA, 39 bp, Artificial Sequence
  Description of Artificial Sequence: Synthetic oligonucleotide
agtaacttcttccctataatttggaatgtgggtggagag

SEQ ID NO: 412865 - DNA, 38 bp, Artificial Sequence
  Description of Artificial Sequence: Synthetic oligonucleotide
gtaacttcttccctataatttggaatgtgggtggagag

SEQ ID NO: 412866 - DNA, 38 bp, Artificial Sequence
  Description of Artificial Sequence: Synthetic oligonucleotide
taacttcttccctataatttggaatgtgggtggagagg

SEQ ID NO: 412867 - DNA, 37 bp, Artificial Sequence
  Description of Artificial Sequence: Synthetic oligonucleotide
aacttcttccctataatttggaatgtgggtggagagg

SEQ ID NO: 412868 - DNA, 36 bp, Artificial Sequence
  Description of Artificial Sequence: Synthetic oligonucleotide
acttcttccctataatttggaatgtgggtggagagg

SEQ ID NO: 412869 - DNA, 35 bp, Artificial Sequence
  Description of Artificial Sequence: Synthetic oligonucleotide
cttcttccctataatttggaatgtgggtggagagg

SEQ ID NO: 412870 - DNA, 35 bp, Artificial Sequence
  Description of Artificial Sequence: Synthetic oligonucleotide
ttcttccctataatttggaatgtgggtggagaggg

SEQ ID NO: 412871 - DNA, 34 bp, Artificial Sequence
  Description of Artificial Sequence: Synthetic oligonucleotide
tcttccctataatttggaatgtgggtggagaggg

SEQ ID NO: 412872 - DNA, 33 bp, Artificial Sequence
  Description of Artificial Sequence: Synthetic oligonucleotide
cttccctataatttggaatgtgggtggagaggg

SEQ ID NO: 412873 - DNA, 33 bp, Artificial Sequence
  Description of Artificial Sequence: Synthetic oligonucleotide
ttccctataatttggaatgtgggtggagagggg

SEQ ID NO: 412874 - DNA, 32 bp, Artificial Sequence
  Description of Artificial Sequence: Synthetic oligonucleotide
tccctataatttggaatgtgggtggagagggg

SEQ ID NO: 412875 - DNA, 31 bp, Artificial Sequence
  Description of Artificial Sequence: Synthetic oligonucleotide
ccctataatttggaatgtgggtggagagggg

SEQ ID NO: 412876 - DNA, 32 bp, Artificial Sequence
  Description of Artificial Sequence: Synthetic oligonucleotide
cctataatttggaatgtgggtggagaggggtc

SEQ ID NO: 412877 - DNA, 35 bp, Artificial Sequence
  Description of Artificial Sequence: Synthetic oligonucleotide
ctataatttggaatgtgggtggagaggggtcatag

SEQ ID NO: 412878 - DNA, 37 bp, Artificial Sequence
  Description of Artificial Sequence: Synthetic oligonucleotide
tataatttggaatgtgggtggagaggggtcatagttc

SEQ ID NO: 412879 - DNA, 36 bp, Artificial Sequence
  Description of Artificial Sequence: Synthetic oligonucleotide
ataatttggaatgtgggtggagaggggtcatagttc

SEQ ID NO: 412880 - DNA, 35 bp, Artificial Sequence
  Description of Artificial Sequence: Synthetic oligonucleotide
taatttggaatgtgggtggagaggggtcatagttc

SEQ ID NO: 412881 - DNA, 34 bp, Artificial Sequence
  Description of Artificial Sequence: Synthetic oligonucleotide
aatttggaatgtgggtggagaggggtcatagttc

SEQ ID NO: 412882 - DNA, 33 bp, Artificial Sequence
  Description of Artificial Sequence: Synthetic oligonucleotide
atttggaatgtgggtggagaggggtcatagttc

SEQ ID NO: 412883 - DNA, 32 bp, Artificial Sequence
  Description of Artificial Sequence: Synthetic oligonucleotide
tttggaatgtgggtggagaggggtcatagttc

SEQ ID NO: 412884 - DNA, 31 bp, Artificial Sequence
  Description of Artificial Sequence: Synthetic oligonucleotide
ttggaatgtgggtggagaggggtcatagttc

SEQ ID NO: 412885 - DNA, 30 bp, Artificial Sequence
  Description of Artificial Sequence: Synthetic oligonucleotide
tggaatgtgggtggagaggggtcatagttc

SEQ ID NO: 412886 - DNA, 29 bp, Artificial Sequence
  Description of Artificial Sequence: Synthetic oligonucleotide
ggaatgtgggtggagaggggtcatagttc

SEQ ID NO: 412887 - DNA, 30 bp, Artificial Sequence
  Description of Artificial Sequence: Synthetic oligonucleotide
gaatgtgggtggagaggggtcatagttctc

SEQ ID NO: 412888 - DNA, 30 bp, Artificial Sequence
  Description of Artificial Sequence: Synthetic oligonucleotide
aatgtgggtggagaggggtcatagttctcc

SEQ ID NO: 412889 - DNA, 29 bp, Artificial Sequence
  Description of Artificial Sequence: Synthetic oligonucleotide
atgtgggtggagaggggtcatagttctcc

SEQ ID NO: 412890 - DNA, 28 bp, Artificial Sequence
  Description of Artificial Sequence: Synthetic oligonucleotide
tgtgggtggagaggggtcatagttctcc

SEQ ID NO: 412891 - DNA, 27 bp, Artificial Sequence
  Description of Artificial Sequence: Synthetic oligonucleotide
gtgggtggagaggggtcatagttctcc

SEQ ID NO: 412892 - DNA, 27 bp, Artificial Sequence
  Description of Artificial Sequence: Synthetic oligonucleotide
tgggtggagaggggtcatagttctccc

SEQ ID NO: 412893 - DNA, 27 bp, Artificial Sequence
  Description of Artificial Sequence: Synthetic oligonucleotide
gggtggagaggggtcatagttctccct

SEQ ID NO: 412894 - DNA, 27 bp, Artificial Sequence
  Description of Artificial Sequence: Synthetic oligonucleotide
ggtggagaggggtcatagttctccctg

SEQ ID NO: 412895 - DNA, 28 bp, Artificial Sequence
  Description of Artificial Sequence: Synthetic oligonucleotide
gtggagaggggtcatagttctccctgag

SEQ ID NO: 412896 - DNA, 29 bp, Artificial Sequence
  Description of Artificial Sequence: Synthetic oligonucleotide
tggagaggggtcatagttctccctgagtg

SEQ ID NO: 412897 - DNA, 28 bp, Artificial Sequence
  Description of Artificial Sequence: Synthetic oligonucleotide
ggagaggggtcatagttctccctgagtg

SEQ ID NO: 412898 - DNA, 29 bp, Artificial Sequence
  Description of Artificial Sequence: Synthetic oligonucleotide
gagaggggtcatagttctccctgagtgag

SEQ ID NO: 412899 - DNA, 30 bp, Artificial Sequence
  Description of Artificial Sequence: Synthetic oligonucleotide
agaggggtcatagttctccctgagtgagac

SEQ ID NO: 412900 - DNA, 29 bp, Artificial Sequence
  Description of Artificial Sequence: Synthetic oligonucleotide
gaggggtcatagttctccctgagtgagac

SEQ ID NO: 412901 - DNA, 30 bp, Artificial Sequence
  Description of Artificial Sequence: Synthetic oligonucleotide
aggggtcatagttctccctgagtgagactc

SEQ ID NO: 412902 - DNA, 29 bp, Artificial Sequence
  Description of Artificial Sequence: Synthetic oligonucleotide
ggggtcatagttctccctgagtgagactc

SEQ ID NO: 412903 - DNA, 30 bp, Artificial Sequence
  Description of Artificial Sequence: Synthetic oligonucleotide
gggtcatagttctccctgagtgagactcac

SEQ ID NO: 412904 - DNA, 30 bp, Artificial Sequence
  Description of Artificial Sequence: Synthetic oligonucleotide
ggtcatagttctccctgagtgagactcacc

SEQ ID NO: 412905 - DNA, 31 bp, Artificial Sequence
  Description of Artificial Sequence: Synthetic oligonucleotide
gtcatagttctccctgagtgagactcacctg

SEQ ID NO: 412906 - DNA, 31 bp, Artificial Sequence
  Description of Artificial Sequence: Synthetic oligonucleotide
tcatagttctccctgagtgagactcacctgc

SEQ ID NO: 412907 - DNA, 30 bp, Artificial Sequence
  Description of Artificial Sequence: Synthetic oligonucleotide
catagttctccctgagtgagactcacctgc

SEQ ID NO: 412908 - DNA, 31 bp, Artificial Sequence
  Description of Artificial Sequence: Synthetic oligonucleotide
atagttctccctgagtgagactcacctgctc

SEQ ID NO: 412909 - DNA, 30 bp, Artificial Sequence
  Description of Artificial Sequence: Synthetic oligonucleotide
tagttctccctgagtgagactcacctgctc

SEQ ID NO: 412910 - DNA, 29 bp, Artificial Sequence
  Description of Artificial Sequence: Synthetic oligonucleotide
agttctccctgagtgagactcacctgctc

SEQ ID NO: 412911 - DNA, 28 bp, Artificial Sequence
  Description of Artificial Sequence: Synthetic oligonucleotide
gttctccctgagtgagactcacctgctc

SEQ ID NO: 412912 - DNA, 28 bp, Artificial Sequence
  Description of Artificial Sequence: Synthetic oligonucleotide
ttctccctgagtgagactcacctgctcc

SEQ ID NO: 412913 - DNA, 27 bp, Artificial Sequence
  Description of Artificial Sequence: Synthetic oligonucleotide
tctccctgagtgagactcacctgctcc

SEQ ID NO: 412914 - DNA, 27 bp, Artificial Sequence
  Description of Artificial Sequence: Synthetic oligonucleotide
ctccctgagtgagactcacctgctcct

SEQ ID NO: 412915 - DNA, 27 bp, Artificial Sequence
  Description of Artificial Sequence: Synthetic oligonucleotide
tccctgagtgagactcacctgctcctc

SEQ ID NO: 412916 - DNA, 27 bp, Artificial Sequence
  Description of Artificial Sequence: Synthetic oligonucleotide
ccctgagtgagactcacctgctcctct

SEQ ID NO: 412917 - DNA, 27 bp, Artificial Sequence
  Description of Artificial Sequence: Synthetic oligonucleotide
cctgagtgagactcacctgctcctctg

SEQ ID NO: 412918 - DNA, 27 bp, Artificial Sequence
  Description of Artificial Sequence: Synthetic oligonucleotide
ctgagtgagactcacctgctcctctgg

SEQ ID NO: 412919 - DNA, 27 bp, Artificial Sequence
  Description of Artificial Sequence: Synthetic oligonucleotide
tgagtgagactcacctgctcctctggc

SEQ ID NO: 412920 - DNA, 26 bp, Artificial Sequence
  Description of Artificial Sequence: Synthetic oligonucleotide
gagtgagactcacctgctcctctggc

SEQ ID NO: 412921 - DNA, 26 bp, Artificial Sequence
  Description of Artificial Sequence: Synthetic oligonucleotide
agtgagactcacctgctcctctggcc

SEQ ID NO: 412922 - DNA, 25 bp, Artificial Sequence
  Description of Artificial Sequence: Synthetic oligonucleotide
gtgagactcacctgctcctctggcc

SEQ ID NO: 412923 - DNA, 25 bp, Artificial Sequence
  Description of Artificial Sequence: Synthetic oligonucleotide
tgagactcacctgctcctctggccc

SEQ ID NO: 412924 - DNA, 24 bp, Artificial Sequence
  Description of Artificial Sequence: Synthetic oligonucleotide
gagactcacctgctcctctggccc

SEQ ID NO: 412925 - DNA, 25 bp, Artificial Sequence
  Description of Artificial Sequence: Synthetic oligonucleotide
agactcacctgctcctctggcccct

SEQ ID NO: 412926 - DNA, 24 bp, Artificial Sequence
  Description of Artificial Sequence: Synthetic oligonucleotide
gactcacctgctcctctggcccct

SEQ ID NO: 412927 - DNA, 24 bp, Artificial Sequence
  Description of Artificial Sequence: Synthetic oligonucleotide
actcacctgctcctctggcccctg

SEQ ID NO: 412928 - DNA, 23 bp, Artificial Sequence
  Description of Artificial Sequence: Synthetic oligonucleotide
ctcacctgctcctctggcccctg

SEQ ID NO: 412929 - DNA, 24 bp, Artificial Sequence
  Description of Artificial Sequence: Synthetic oligonucleotide
tcacctgctcctctggcccctggt

SEQ ID NO: 412930 - DNA, 23 bp, Artificial Sequence
  Description of Artificial Sequence: Synthetic oligonucleotide
cacctgctcctctggcccctggt

SEQ ID NO: 412931 - DNA, 23 bp, Artificial Sequence
  Description of Artificial Sequence: Synthetic oligonucleotide
acctgctcctctggcccctggtc

SEQ ID NO: 412932 - DNA, 22 bp, Artificial Sequence
  Description of Artificial Sequence: Synthetic oligonucleotide
cctgctcctctggcccctggtc

SEQ ID NO: 412933 - DNA, 23 bp, Artificial Sequence
  Description of Artificial Sequence: Synthetic oligonucleotide
ctgctcctctggcccctggtcct

SEQ ID NO: 412934 - DNA, 24 bp, Artificial Sequence
  Description of Artificial Sequence: Synthetic oligonucleotide
tgctcctctggcccctggtcctgt

SEQ ID NO: 412935 - DNA, 23 bp, Artificial Sequence
  Description of Artificial Sequence: Synthetic oligonucleotide
gctcctctggcccctggtcctgt

SEQ ID NO: 412936 - DNA, 23 bp, Artificial Sequence
  Description of Artificial Sequence: Synthetic oligonucleotide
ctcctctggcccctggtcctgtc

SEQ ID NO: 412937 - DNA, 24 bp, Artificial Sequence
  Description of Artificial Sequence: Synthetic oligonucleotide
tcctctggcccctggtcctgtcct

SEQ ID NO: 412938 - DNA, 23 bp, Artificial Sequence
  Description of Artificial Sequence: Synthetic oligonucleotide
cctctggcccctggtcctgtcct

SEQ ID NO: 412939 - DNA, 32 bp, Artificial Sequence
  Description of Artificial Sequence: Synthetic oligonucleotide
tcctgttctccagcatggtgtgtctgaagttc

SEQ ID NO: 412940 - DNA, 31 bp, Artificial Sequence
  Description of Artificial Sequence: Synthetic oligonucleotide
cctgttctccagcatggtgtgtctgaagttc

SEQ ID NO: 412941 - DNA, 31 bp, Artificial Sequence
  Description of Artificial Sequence: Synthetic oligonucleotide
ctgttctccagcatggtgtgtctgaagttcc

SEQ ID NO: 412942 - DNA, 31 bp, Artificial Sequence
  Description of Artificial Sequence: Synthetic oligonucleotide
tgttctccagcatggtgtgtctgaagttccc

SEQ ID NO: 412943 - DNA, 30 bp, Artificial Sequence
  Description of Artificial Sequence: Synthetic oligonucleotide
gttctccagcatggtgtgtctgaagttccc

SEQ ID NO: 412944 - DNA, 31 bp, Artificial Sequence
  Description of Artificial Sequence: Synthetic oligonucleotide
ttctccagcatggtgtgtctgaagttccctg

SEQ ID NO: 412945 - DNA, 30 bp, Artificial Sequence
  Description of Artificial Sequence: Synthetic oligonucleotide
tctccagcatggtgtgtctgaagttccctg

SEQ ID NO: 412946 - DNA, 29 bp, Artificial Sequence
  Description of Artificial Sequence: Synthetic oligonucleotide
ctccagcatggtgtgtctgaagttccctg

SEQ ID NO: 412947 - DNA, 29 bp, Artificial Sequence
  Description of Artificial Sequence: Synthetic oligonucleotide
tccagcatggtgtgtctgaagttccctgg

SEQ ID NO: 412948 - DNA, 28 bp, Artificial Sequence
  Description of Artificial Sequence: Synthetic oligonucleotide
ccagcatggtgtgtctgaagttccctgg

SEQ ID NO: 412949 - DNA, 29 bp, Artificial Sequence
  Description of Artificial Sequence: Synthetic oligonucleotide
cagcatggtgtgtctgaagttccctggag

SEQ ID NO: 412950 - DNA, 29 bp, Artificial Sequence
  Description of Artificial Sequence: Synthetic oligonucleotide
agcatggtgtgtctgaagttccctggagg

SEQ ID NO: 412951 - DNA, 28 bp, Artificial Sequence
  Description of Artificial Sequence: Synthetic oligonucleotide
gcatggtgtgtctgaagttccctggagg

SEQ ID NO: 412952 - DNA, 28 bp, Artificial Sequence
  Description of Artificial Sequence: Synthetic oligonucleotide
catggtgtgtctgaagttccctggaggc

SEQ ID NO: 412953 - DNA, 30 bp, Artificial Sequence; identical to SEQ ID NO: 66703
  Description of Artificial Sequence: Synthetic oligonucleotide

SEQ ID NO: 412954 - DNA, 29 bp, Artificial Sequence
  Description of Artificial Sequence: Synthetic oligonucleotide
actacggggttgtggagagcttcacagtc

SEQ ID NO: 412955 - DNA, 28 bp, Artificial Sequence
  Description of Artificial Sequence: Synthetic oligonucleotide
ctacggggttgtggagagcttcacagtc

SEQ ID NO: 412956 - DNA, 28 bp, Artificial Sequence
  Description of Artificial Sequence: Synthetic oligonucleotide
tacggggttgtggagagcttcacagtcc

SEQ ID NO: 412957 - DNA, 27 bp, Artificial Sequence
  Description of Artificial Sequence: Synthetic oligonucleotide
acggggttgtggagagcttcacagtcc

SEQ ID NO: 412958 - DNA, 27 bp, Artificial Sequence
  Description of Artificial Sequence: Synthetic oligonucleotide
cggggttgtggagagcttcacagtcca

SEQ ID NO: 412959 - DNA, 27 bp, Artificial Sequence
  Description of Artificial Sequence: Synthetic oligonucleotide
ggggttgtggagagcttcacagtccag

SEQ ID NO: 412960 - DNA, 27 bp, Artificial Sequence
  Description of Artificial Sequence: Synthetic oligonucleotide
gggttgtggagagcttcacagtccagc

SEQ ID NO: 412961 - DNA, 27 bp, Artificial Sequence
  Description of Artificial Sequence: Synthetic oligonucleotide
ggttgtggagagcttcacagtccagcg

SEQ ID NO: 412962 - DNA, 27 bp, Artificial Sequence
  Description of Artificial Sequence: Synthetic oligonucleotide
gttgtggagagcttcacagtccagcgg

SEQ ID NO: 412963 - DNA, 27 bp, Artificial Sequence
  Description of Artificial Sequence: Synthetic oligonucleotide
ttgtggagagcttcacagtccagcggc

SEQ ID NO: 412964 - DNA, 26 bp, Artificial Sequence
  Description of Artificial Sequence: Synthetic oligonucleotide
tgtggagagcttcacagtccagcggc

SEQ ID NO: 412965 - DNA, 25 bp, Artificial Sequence
  Description of Artificial Sequence: Synthetic oligonucleotide
gtggagagcttcacagtccagcggc

SEQ ID NO: 412966 - DNA, 26 bp, Artificial Sequence
  Description of Artificial Sequence: Synthetic oligonucleotide
tggagagcttcacagtccagcggcga

SEQ ID NO: 412967 - DNA, 25 bp, Artificial Sequence
  Description of Artificial Sequence: Synthetic oligonucleotide
ggagagcttcacagtccagcggcga

SEQ ID NO: 412968 - DNA, 25 bp, Artificial Sequence
  Description of Artificial Sequence: Synthetic oligonucleotide
gagagcttcacagtccagcggcgag

SEQ ID NO: 412969 - DNA, 24 bp, Artificial Sequence
  Description of Artificial Sequence: Synthetic oligonucleotide
ggccgaggtggacacctactgcag

SEQ ID NO: 412970 - DNA, 24 bp, Artificial Sequence
  Description of Artificial Sequence: Synthetic oligonucleotide
gccgaggtggacacctactgcagg

SEQ ID NO: 412971 - DNA, 25 bp, Artificial Sequence
  Description of Artificial Sequence: Synthetic oligonucleotide
ccgaggtggacacctactgcaggca

SEQ ID NO: 412972 - DNA, 27 bp, Artificial Sequence
  Description of Artificial Sequence: Synthetic oligonucleotide
cgaggtggacacctactgcaggcacaa

SEQ ID NO: 412973 - DNA, 27 bp, Artificial Sequence
  Description of Artificial Sequence: Synthetic oligonucleotide
gaggtggacacctactgcaggcacaac

SEQ ID NO: 412974 - DNA, 29 bp, Artificial Sequence
  Description of Artificial Sequence: Synthetic oligonucleotide
aggtggacacctactgcaggcacaactac

SEQ ID NO: 412975 - DNA, 28 bp, Artificial Sequence
  Description of Artificial Sequence: Synthetic oligonucleotide
ggtggacacctactgcaggcacaactac

SEQ ID NO: 412976 - DNA, 28 bp, Artificial Sequence
  Description of Artificial Sequence: Synthetic oligonucleotide
gtggacacctactgcaggcacaactacg

SEQ ID NO: 412977 - DNA, 28 bp, Artificial Sequence
  Description of Artificial Sequence: Synthetic oligonucleotide
tggacacctactgcaggcacaactacgg

SEQ ID NO: 412978 - DNA, 27 bp, Artificial Sequence
  Description of Artificial Sequence: Synthetic oligonucleotide
ggacacctactgcaggcacaactacgg

SEQ ID NO: 412979 - DNA, 27 bp, Artificial Sequence
  Description of Artificial Sequence: Synthetic oligonucleotide
gacacctactgcaggcacaactacggg

SEQ ID NO: 412980 - DNA, 27 bp, Artificial Sequence
  Description of Artificial Sequence: Synthetic oligonucleotide
acacctactgcaggcacaactacgggg

SEQ ID NO: 412981 - DNA, 27 bp, Artificial Sequence
  Description of Artificial Sequence: Synthetic oligonucleotide
cacctactgcaggcacaactacggggt

SEQ ID NO: 412982 - DNA, 28 bp, Artificial Sequence
  Description of Artificial Sequence: Synthetic oligonucleotide
acctactgcaggcacaactacggggttg

SEQ ID NO: 412983 - DNA, 27 bp, Artificial Sequence
  Description of Artificial Sequence: Synthetic oligonucleotide
cctactgcaggcacaactacggggttg

SEQ ID NO: 412984 - DNA, 28 bp, Artificial Sequence
  Description of Artificial Sequence: Synthetic oligonucleotide
ctactgcaggcacaactacggggttgtg

SEQ ID NO: 412985 - DNA, 28 bp, Artificial Sequence
  Description of Artificial Sequence: Synthetic oligonucleotide
tactgcaggcacaactacggggttgtgg

SEQ ID NO: 412986 - DNA, 27 bp, Artificial Sequence
  Description of Artificial Sequence: Synthetic oligonucleotide
actgcaggcacaactacggggttgtgg

SEQ ID NO: 412987 - DNA, 27 bp, Artificial Sequence
  Description of Artificial Sequence: Synthetic oligonucleotide
ctgcaggcacaactacggggttgtgga

SEQ ID NO: 412988 - DNA, 27 bp, Artificial Sequence
  Description of Artificial Sequence: Synthetic oligonucleotide
tgcaggcacaactacggggttgtggag

SEQ ID NO: 412989 - DNA, 27 bp, Artificial Sequence
  Description of Artificial Sequence: Synthetic oligonucleotide
gcaggcacaactacggggttgtggaga

SEQ ID NO: 412990 - DNA, 27 bp, Artificial Sequence
  Description of Artificial Sequence: Synthetic oligonucleotide
caggcacaactacggggttgtggagag

SEQ ID NO: 412991 - DNA, 27 bp, Artificial Sequence
  Description of Artificial Sequence: Synthetic oligonucleotide
aggcacaactacggggttgtggagagc

SEQ ID NO: 412992 - DNA, 27 bp, Artificial Sequence
  Description of Artificial Sequence: Synthetic oligonucleotide
ggcacaactacggggttgtggagagct

SEQ ID NO: 412993 - DNA, 28 bp, Artificial Sequence
  Description of Artificial Sequence: Synthetic oligonucleotide
gcacaactacggggttgtggagagcttc

SEQ ID NO: 412994 - DNA, 29 bp, Artificial Sequence
  Description of Artificial Sequence: Synthetic oligonucleotide
cgagtactggaacagccagaaggaccttc

SEQ ID NO: 412995 - DNA, 30 bp, Artificial Sequence; identical to SEQ ID NO: 66745
  Description of Artificial Sequence: Synthetic oligonucleotide

SEQ ID NO: 412996 - DNA, 30 bp, Artificial Sequence; identical to SEQ ID NO: 66746
  Description of Artificial Sequence: Synthetic oligonucleotide

SEQ ID NO: 412997 - DNA, 29 bp, Artificial Sequence
  Description of Artificial Sequence: Synthetic oligonucleotide
gtactggaacagccagaaggaccttctgg

SEQ ID NO: 412998 - DNA, 30 bp, Artificial Sequence; identical to SEQ ID NO: 66748
  Description of Artificial Sequence: Synthetic oligonucleotide

SEQ ID NO: 412999 - DNA, 29 bp, Artificial Sequence
  Description of Artificial Sequence: Synthetic oligonucleotide
actggaacagccagaaggaccttctggag

SEQ ID NO: 413000 - DNA, 28 bp, Artificial Sequence
  Description of Artificial Sequence: Synthetic oligonucleotide
ctggaacagccagaaggaccttctggag

SEQ ID NO: 413001 - DNA, 28 bp, Artificial Sequence
  Description of Artificial Sequence: Synthetic oligonucleotide
tggaacagccagaaggaccttctggagc

SEQ ID NO: 413002 - DNA, 27 bp, Artificial Sequence
  Description of Artificial Sequence: Synthetic oligonucleotide
ggaacagccagaaggaccttctggagc

SEQ ID NO: 413003 - DNA, 28 bp, Artificial Sequence
  Description of Artificial Sequence: Synthetic oligonucleotide
gaacagccagaaggaccttctggagcag

SEQ ID NO: 413004 - DNA, 29 bp, Artificial Sequence
  Description of Artificial Sequence: Synthetic oligonucleotide
aacagccagaaggaccttctggagcagag

SEQ ID NO: 413005 - DNA, 28 bp, Artificial Sequence
  Description of Artificial Sequence: Synthetic oligonucleotide
acagccagaaggaccttctggagcagag

SEQ ID NO: 413006 - DNA, 27 bp, Artificial Sequence
  Description of Artificial Sequence: Synthetic oligonucleotide
cagccagaaggaccttctggagcagag

SEQ ID NO: 413007 - DNA, 27 bp, Artificial Sequence
  Description of Artificial Sequence: Synthetic oligonucleotide
agccagaaggaccttctggagcagagg

SEQ ID NO: 413008 - DNA, 26 bp, Artificial Sequence
  Description of Artificial Sequence: Synthetic oligonucleotide
gccagaaggaccttctggagcagagg

SEQ ID NO: 413009 - DNA, 26 bp, Artificial Sequence
  Description of Artificial Sequence: Synthetic oligonucleotide
ccagaaggaccttctggagcagaggc

SEQ ID NO: 413010 - DNA, 26 bp, Artificial Sequence
  Description of Artificial Sequence: Synthetic oligonucleotide
cagaaggaccttctggagcagaggcg

SEQ ID NO: 413011 - DNA, 26 bp, Artificial Sequence
  Description of Artificial Sequence: Synthetic oligonucleotide
agaaggaccttctggagcagaggcgg

SEQ ID NO: 413012 - DNA, 25 bp, Artificial Sequence
  Description of Artificial Sequence: Synthetic oligonucleotide
gaaggaccttctggagcagaggcgg

SEQ ID NO: 413013 - DNA, 25 bp, Artificial Sequence
  Description of Artificial Sequence: Synthetic oligonucleotide
aaggaccttctggagcagaggcggg

SEQ ID NO: 413014 - DNA, 24 bp, Artificial Sequence
  Description of Artificial Sequence: Synthetic oligonucleotide
aggaccttctggagcagaggcggg

SEQ ID NO: 413015 - DNA, 23 bp, Artificial Sequence
  Description of Artificial Sequence: Synthetic oligonucleotide
ggaccttctggagcagaggcggg

SEQ ID NO: 413016 - DNA, 23 bp, Artificial Sequence
  Description of Artificial Sequence: Synthetic oligonucleotide
gaccttctggagcagaggcgggc

SEQ ID NO: 413017 - DNA, 23 bp, Artificial Sequence
  Description of Artificial Sequence: Synthetic oligonucleotide
accttctggagcagaggcgggcc

SEQ ID NO: 413018 - DNA, 22 bp, Artificial Sequence
  Description of Artificial Sequence: Synthetic oligonucleotide
ccttctggagcagaggcgggcc

SEQ ID NO: 413019 - DNA, 22 bp, Artificial Sequence
  Description of Artificial Sequence: Synthetic oligonucleotide
cttctggagcagaggcgggccg

SEQ ID NO: 413020 - DNA, 22 bp, Artificial Sequence
  Description of Artificial Sequence: Synthetic oligonucleotide
ttctggagcagaggcgggccgc

SEQ ID NO: 413021 - DNA, 21 bp, Artificial Sequence
  Description of Artificial Sequence: Synthetic oligonucleotide
tctggagcagaggcgggccgc

SEQ ID NO: 413022 - DNA, 30 bp, Artificial Sequence; identical to SEQ ID NO: 66772
  Description of Artificial Sequence: Synthetic oligonucleotide

SEQ ID NO: 413023 - DNA, 30 bp, Artificial Sequence; identical to SEQ ID NO: 66773
  Description of Artificial Sequence: Synthetic oligonucleotide

SEQ ID NO: 413024 - DNA, 30 bp, Artificial Sequence; identical to SEQ ID NO: 66774
  Description of Artificial Sequence: Synthetic oligonucleotide

SEQ ID NO: 413025 - DNA, 30 bp, Artificial Sequence; identical to SEQ ID NO: 66775
  Description of Artificial Sequence: Synthetic oligonucleotide

SEQ ID NO: 413026 - DNA, 29 bp, Artificial Sequence
  Description of Artificial Sequence: Synthetic oligonucleotide
ggacacctactgcagacacaactatgggg

SEQ ID NO: 413027 - DNA, 31 bp, Artificial Sequence; identical to SEQ ID NO: 66777
  Description of Artificial Sequence: Synthetic oligonucleotide

SEQ ID NO: 413028 - DNA, 32 bp, Artificial Sequence; identical to SEQ ID NO: 66778
  Description of Artificial Sequence: Synthetic oligonucleotide

SEQ ID NO: 413029 - DNA, 31 bp, Artificial Sequence; identical to SEQ ID NO: 66779
  Description of Artificial Sequence: Synthetic oligonucleotide

SEQ ID NO: 413030 - DNA, 31 bp, Artificial Sequence; identical to SEQ ID NO: 66780
  Description of Artificial Sequence: Synthetic oligonucleotide

SEQ ID NO: 413031 - DNA, 30 bp, Artificial Sequence; identical to SEQ ID NO: 66781
  Description of Artificial Sequence: Synthetic oligonucleotide

SEQ ID NO: 413032 - DNA, 31 bp, Artificial Sequence; identical to SEQ ID NO: 66782
  Description of Artificial Sequence: Synthetic oligonucleotide

SEQ ID NO: 413033 - DNA, 32 bp, Artificial Sequence; identical to SEQ ID NO: 66783
  Description of Artificial Sequence: Synthetic oligonucleotide

SEQ ID NO: 413034 - DNA, 31 bp, Artificial Sequence; identical to SEQ ID NO: 66784
  Description of Artificial Sequence: Synthetic oligonucleotide

SEQ ID NO: 413035 - DNA, 30 bp, Artificial Sequence; identical to SEQ ID NO: 66785
  Description of Artificial Sequence: Synthetic oligonucleotide

SEQ ID NO: 413036 - DNA, 30 bp, Artificial Sequence; identical to SEQ ID NO: 66786
  Description of Artificial Sequence: Synthetic oligonucleotide

SEQ ID NO: 413037 - DNA, 29 bp, Artificial Sequence
  Description of Artificial Sequence: Synthetic oligonucleotide
gcagacacaactatggggttgtggagagc

SEQ ID NO: 413038 - DNA, 31 bp, Artificial Sequence; identical to SEQ ID NO: 66788
  Description of Artificial Sequence: Synthetic oligonucleotide

SEQ ID NO: 413039 - DNA, 32 bp, Artificial Sequence; identical to SEQ ID NO: 66789
  Description of Artificial Sequence: Synthetic oligonucleotide

SEQ ID NO: 413040 - DNA, 31 bp, Artificial Sequence; identical to SEQ ID NO: 66790
  Description of Artificial Sequence: Synthetic oligonucleotide

SEQ ID NO: 413041 - DNA, 32 bp, Artificial Sequence; identical to SEQ ID NO: 66791
  Description of Artificial Sequence: Synthetic oligonucleotide

SEQ ID NO: 413042 - DNA, 31 bp, Artificial Sequence; identical to SEQ ID NO: 66792
  Description of Artificial Sequence: Synthetic oligonucleotide

SEQ ID NO: 413043 - DNA, 32 bp, Artificial Sequence; identical to SEQ ID NO: 66793
  Description of Artificial Sequence: Synthetic oligonucleotide

SEQ ID NO: 413044 - DNA, 31 bp, Artificial Sequence; identical to SEQ ID NO: 66794
  Description of Artificial Sequence: Synthetic oligonucleotide

SEQ ID NO: 413045 - DNA, 31 bp, Artificial Sequence; identical to SEQ ID NO: 66795
  Description of Artificial Sequence: Synthetic oligonucleotide

SEQ ID NO: 413046 - DNA, 30 bp, Artificial Sequence; identical to SEQ ID NO: 66796
  Description of Artificial Sequence: Synthetic oligonucleotide

SEQ ID NO: 413047 - DNA, 29 bp, Artificial Sequence
  Description of Artificial Sequence: Synthetic oligonucleotide
ctatggggttgtggagagcttcacagtgc

SEQ ID NO: 413048 - DNA, 30 bp, Artificial Sequence; identical to SEQ ID NO: 66798
  Description of Artificial Sequence: Synthetic oligonucleotide

SEQ ID NO: 413049 - DNA, 29 bp, Artificial Sequence
  Description of Artificial Sequence: Synthetic oligonucleotide
atggggttgtggagagcttcacagtgcag

SEQ ID NO: 413050 - DNA, 28 bp, Artificial Sequence
  Description of Artificial Sequence: Synthetic oligonucleotide
tggggttgtggagagcttcacagtgcag

SEQ ID NO: 413051 - DNA, 24 bp, Artificial Sequence
  Description of Artificial Sequence: Synthetic oligonucleotide
aaggacctcctggagcagaggcgc

SEQ ID NO: 413052 - DNA, 23 bp, Artificial Sequence
  Description of Artificial Sequence: Synthetic oligonucleotide
aggacctcctggagcagaggcgc

SEQ ID NO: 413053 - DNA, 22 bp, Artificial Sequence
  Description of Artificial Sequence: Synthetic oligonucleotide
ggacctcctggagcagaggcgc

SEQ ID NO: 413054 - DNA, 22 bp, Artificial Sequence
  Description of Artificial Sequence: Synthetic oligonucleotide
gacctcctggagcagaggcgcg

SEQ ID NO: 413055 - DNA, 22 bp, Artificial Sequence
  Description of Artificial Sequence: Synthetic oligonucleotide
acctcctggagcagaggcgcgc

SEQ ID NO: 413056 - DNA, 21 bp, Artificial Sequence
  Description of Artificial Sequence: Synthetic oligonucleotide
cctcctggagcagaggcgcgc

SEQ ID NO: 413057 - DNA, 21 bp, Artificial Sequence
  Description of Artificial Sequence: Synthetic oligonucleotide
ctcctggagcagaggcgcgcc

SEQ ID NO: 413058 - DNA, 21 bp, Artificial Sequence
  Description of Artificial Sequence: Synthetic oligonucleotide
tcctggagcagaggcgcgccg

SEQ ID NO: 413059 - DNA, 20 bp, Artificial Sequence
  Description of Artificial Sequence: Synthetic oligonucleotide
cctggagcagaggcgcgccg

SEQ ID NO: 413060 - DNA, 20 bp, Artificial Sequence
  Description of Artificial Sequence: Synthetic oligonucleotide
ctggagcagaggcgcgccgc

SEQ ID NO: 413061 - DNA, 20 bp, Artificial Sequence
  Description of Artificial Sequence: Synthetic oligonucleotide
tggagcagaggcgcgccgcg

SEQ ID NO: 413062 - DNA, 20 bp, Artificial Sequence
  Description of Artificial Sequence: Synthetic oligonucleotide
ggagcagaggcgcgccgcgt

SEQ ID NO: 413063 - DNA, 20 bp, Artificial Sequence
  Description of Artificial Sequence: Synthetic oligonucleotide
gagcagaggcgcgccgcggt

SEQ ID NO: 413064 - DNA, 20 bp, Artificial Sequence
  Description of Artificial Sequence: Synthetic oligonucleotide
agcagaggcgcgccgcggtg

SEQ ID NO: 413065 - DNA, 20 bp, Artificial Sequence
  Description of Artificial Sequence: Synthetic oligonucleotide
gcagaggcgcgccgcggtgt

SEQ ID NO: 413066 - DNA, 20 bp, Artificial Sequence
  Description of Artificial Sequence: Synthetic oligonucleotide
cagaggcgcgccgcggtgga

SEQ ID NO: 413067 - DNA, 21 bp, Artificial Sequence
  Description of Artificial Sequence: Synthetic oligonucleotide
agaggcgcgccgcggtggaca

SEQ ID NO: 413068 - DNA, 20 bp, Artificial Sequence
  Description of Artificial Sequence: Synthetic oligonucleotide
gaggcgcgccgcggtggaca

SEQ ID NO: 413069 - DNA, 21 bp, Artificial Sequence
  Description of Artificial Sequence: Synthetic oligonucleotide
gcgcgccgcggtggacaccta

SEQ ID NO: 413070 - DNA, 22 bp, Artificial Sequence
  Description of Artificial Sequence: Synthetic oligonucleotide
cgcgccgcggtggacacctact

SEQ ID NO: 413071 - DNA, 22 bp, Artificial Sequence
  Description of Artificial Sequence: Synthetic oligonucleotide
gcgccgcggtggacacctactg

SEQ ID NO: 413072 - DNA, 23 bp, Artificial Sequence
  Description of Artificial Sequence: Synthetic oligonucleotide
cgccgcggtggacacctactgca

SEQ ID NO: 413073 - DNA, 33 bp, Artificial Sequence; identical to SEQ ID NO: 66823
  Description of Artificial Sequence: Synthetic oligonucleotide

SEQ ID NO: 413074 - DNA, 32 bp, Artificial Sequence; identical to SEQ ID NO: 66824
  Description of Artificial Sequence: Synthetic oligonucleotide

SEQ ID NO: 413075 - DNA, 34 bp, Artificial Sequence; identical to SEQ ID NO: 66825
  Description of Artificial Sequence: Synthetic oligonucleotide

SEQ ID NO: 413076 - DNA, 33 bp, Artificial Sequence; identical to SEQ ID NO: 66826
  Description of Artificial Sequence: Synthetic oligonucleotide

SEQ ID NO: 413077 - DNA, 32 bp, Artificial Sequence; identical to SEQ ID NO: 66827
  Description of Artificial Sequence: Synthetic oligonucleotide

SEQ ID NO: 413078 - DNA, 31 bp, Artificial Sequence; identical to SEQ ID NO: 66828
  Description of Artificial Sequence: Synthetic oligonucleotide

SEQ ID NO: 413079 - DNA, 31 bp, Artificial Sequence; identical to SEQ ID NO: 66829
  Description of Artificial Sequence: Synthetic oligonucleotide

SEQ ID NO: 413080 - DNA, 30 bp, Artificial Sequence; identical to SEQ ID NO: 66830
  Description of Artificial Sequence: Synthetic oligonucleotide

SEQ ID NO: 413081 - DNA, 29 bp, Artificial Sequence
  Description of Artificial Sequence: Synthetic oligonucleotide
ctatcaccaagaggagtacgtgcggttcg

SEQ ID NO: 413082 - DNA, 30 bp, Artificial Sequence; identical to SEQ ID NO: 66832
  Description of Artificial Sequence: Synthetic oligonucleotide

SEQ ID NO: 413083 - DNA, 29 bp, Artificial Sequence
  Description of Artificial Sequence: Synthetic oligonucleotide
atcaccaagaggagtacgtgcggttcgac

SEQ ID NO: 413084 - DNA, 28 bp, Artificial Sequence
  Description of Artificial Sequence: Synthetic oligonucleotide
tcaccaagaggagtacgtgcggttcgac

SEQ ID NO: 413085 - DNA, 27 bp, Artificial Sequence
  Description of Artificial Sequence: Synthetic oligonucleotide
caccaagaggagtacgtgcggttcgac

SEQ ID NO: 413086 - DNA, 28 bp, Artificial Sequence
  Description of Artificial Sequence: Synthetic oligonucleotide
accaagaggagtacgtgcggttcgacag

SEQ ID NO: 413087 - DNA, 27 bp, Artificial Sequence
  Description of Artificial Sequence: Synthetic oligonucleotide
ccaagaggagtacgtgcggttcgacag

SEQ ID NO: 413088 - DNA, 27 bp, Artificial Sequence
  Description of Artificial Sequence: Synthetic oligonucleotide
caagaggagtacgtgcggttcgacagc

SEQ ID NO: 413089 - DNA, 27 bp, Artificial Sequence
  Description of Artificial Sequence: Synthetic oligonucleotide
aagaggagtacgtgcggttcgacagcg

SEQ ID NO: 413090 - DNA, 27 bp, Artificial Sequence
  Description of Artificial Sequence: Synthetic oligonucleotide
agaggagtacgtgcggttcgacagcga

SEQ ID NO: 413091 - DNA, 26 bp, Artificial Sequence
  Description of Artificial Sequence: Synthetic oligonucleotide
gaggagtacgtgcggttcgacagcga

SEQ ID NO: 413092 - DNA, 26 bp, Artificial Sequence
  Description of Artificial Sequence: Synthetic oligonucleotide
aggagtacgtgcggttcgacagcgac

SEQ ID NO: 413093 - DNA, 25 bp, Artificial Sequence
  Description of Artificial Sequence: Synthetic oligonucleotide
ggagtacgtgcggttcgacagcgac

SEQ ID NO: 413094 - DNA, 26 bp, Artificial Sequence
  Description of Artificial Sequence: Synthetic oligonucleotide
gagtacgtgcggttcgacagcgacgt

SEQ ID NO: 413095 - DNA, 26 bp, Artificial Sequence
  Description of Artificial Sequence: Synthetic oligonucleotide
agtacgtgcggttcgacagcgacgtg

SEQ ID NO: 413096 - DNA, 25 bp, Artificial Sequence
  Description of Artificial Sequence: Synthetic oligonucleotide
gtacgtgcggttcgacagcgacgtg

SEQ ID NO: 413097 - DNA, 25 bp, Artificial Sequence
  Description of Artificial Sequence: Synthetic oligonucleotide
tacgtgcggttcgacagcgacgtgg

SEQ ID NO: 413098 - DNA, 24 bp, Artificial Sequence
  Description of Artificial Sequence: Synthetic oligonucleotide
acgtgcggttcgacagcgacgtgg

SEQ ID NO: 413099 - DNA, 23 bp, Artificial Sequence
  Description of Artificial Sequence: Synthetic oligonucleotide
cgtgcggttcgacagcgacgtgg

SEQ ID NO: 413100 - DNA, 23 bp, Artificial Sequence
  Description of Artificial Sequence: Synthetic oligonucleotide
gtgcggttcgacagcgacgtggg

SEQ ID NO: 413101 - DNA, 23 bp, Artificial Sequence
  Description of Artificial Sequence: Synthetic oligonucleotide
tgcggttcgacagcgacgtgggg

SEQ ID NO: 413102 - DNA, 22 bp, Artificial Sequence
  Description of Artificial Sequence: Synthetic oligonucleotide
gcggttcgacagcgacgtgggg

SEQ ID NO: 413103 - DNA, 23 bp, Artificial Sequence
  Description of Artificial Sequence: Synthetic oligonucleotide
cggttcgacagcgacgtggggga

SEQ ID NO: 413104 - DNA, 25 bp, Artificial Sequence
  Description of Artificial Sequence: Synthetic oligonucleotide
ggttcgacagcgacgtgggggagta

SEQ ID NO: 413105 - DNA, 25 bp, Artificial Sequence
  Description of Artificial Sequence: Synthetic oligonucleotide
gttcgacagcgacgtgggggagtac

SEQ ID NO: 413106 - DNA, 28 bp, Artificial Sequence
  Description of Artificial Sequence: Synthetic oligonucleotide
gttggtgagagcttcacagtgcagcgac

SEQ ID NO: 413107 - DNA, 28 bp, Artificial Sequence
  Description of Artificial Sequence: Synthetic oligonucleotide
ttggtgagagcttcacagtgcagcgacg

SEQ ID NO: 413108 - DNA, 27 bp, Artificial Sequence
  Description of Artificial Sequence: Synthetic oligonucleotide
tggtgagagcttcacagtgcagcgacg

SEQ ID NO: 413109 - DNA, 27 bp, Artificial Sequence
  Description of Artificial Sequence: Synthetic oligonucleotide
ggtgagagcttcacagtgcagcgacga

SEQ ID NO: 413110 - DNA, 27 bp, Artificial Sequence
  Description of Artificial Sequence: Synthetic oligonucleotide
gtgagagcttcacagtgcagcgacgag

SEQ ID NO: 413111 - DNA, 26 bp, Artificial Sequence
  Description of Artificial Sequence: Synthetic oligonucleotide
cttcgacagcgacgtgggggagtaca

SEQ ID NO: 413112 - DNA, 26 bp, Artificial Sequence
  Description of Artificial Sequence: Synthetic oligonucleotide
ttcgacagcgacgtgggggagtacag

SEQ ID NO: 413113 - DNA, 25 bp, Artificial Sequence
  Description of Artificial Sequence: Synthetic oligonucleotide
tcgacagcgacgtgggggagtacag

SEQ ID NO: 413114 - DNA, 24 bp, Artificial Sequence
  Description of Artificial Sequence: Synthetic oligonucleotide
cgacagcgacgtgggggagtacag

SEQ ID NO: 413115 - DNA, 24 bp, Artificial Sequence
  Description of Artificial Sequence: Synthetic oligonucleotide
gacagcgacgtgggggagtacagg

SEQ ID NO: 413116 - DNA, 24 bp, Artificial Sequence
  Description of Artificial Sequence: Synthetic oligonucleotide
acagcgacgtgggggagtacaggg

SEQ ID NO: 413117 - DNA, 23 bp, Artificial Sequence
  Description of Artificial Sequence: Synthetic oligonucleotide
cagcgacgtgggggagtacaggg

SEQ ID NO: 413118 - DNA, 23 bp, Artificial Sequence
  Description of Artificial Sequence: Synthetic oligonucleotide
agcgacgtgggggagtacagggc

SEQ ID NO: 413119 - DNA, 22 bp, Artificial Sequence
  Description of Artificial Sequence: Synthetic oligonucleotide
gcgacgtgggggagtacagggc

SEQ ID NO: 413120 - DNA, 22 bp, Artificial Sequence
  Description of Artificial Sequence: Synthetic oligonucleotide
cgacgtgggggagtacagggcg

SEQ ID NO: 413121 - DNA, 23 bp, Artificial Sequence
  Description of Artificial Sequence: Synthetic oligonucleotide
gacgtgggggagtacagggcggt

SEQ ID NO: 413122 - DNA, 24 bp, Artificial Sequence
  Description of Artificial Sequence: Synthetic oligonucleotide
acgtgggggagtacagggcggtga

SEQ ID NO: 413123 - DNA, 23 bp, Artificial Sequence
  Description of Artificial Sequence: Synthetic oligonucleotide
cgtgggggagtacagggcggtga

SEQ ID NO: 413124 - DNA, 23 bp, Artificial Sequence
  Description of Artificial Sequence: Synthetic oligonucleotide
gtgggggagtacagggcggtgac

SEQ ID NO: 413125 - DNA, 23 bp, Artificial Sequence
  Description of Artificial Sequence: Synthetic oligonucleotide
tgggggagtacagggcggtgacg

SEQ ID NO: 413126 - DNA, 22 bp, Artificial Sequence
  Description of Artificial Sequence: Synthetic oligonucleotide
gggggagtacagggcggtgacg

SEQ ID NO: 413127 - DNA, 23 bp, Artificial Sequence
  Description of Artificial Sequence: Synthetic oligonucleotide
ggggagtacagggcggtgacgga

SEQ ID NO: 413128 - DNA, 23 bp, Artificial Sequence
  Description of Artificial Sequence: Synthetic oligonucleotide
gggagtacagggcggtgacggag

SEQ ID NO: 413129 - DNA, 24 bp, Artificial Sequence
  Description of Artificial Sequence: Synthetic oligonucleotide
ggagtacagggcggtgacggagct

SEQ ID NO: 413130 - DNA, 24 bp, Artificial Sequence
  Description of Artificial Sequence: Synthetic oligonucleotide
gagtacagggcggtgacggagctg

SEQ ID NO: 413131 - DNA, 24 bp, Artificial Sequence
  Description of Artificial Sequence: Synthetic oligonucleotide
agtacagggcggtgacggagctgg

SEQ ID NO: 413132 - DNA, 23 bp, Artificial Sequence
  Description of Artificial Sequence: Synthetic oligonucleotide
gtacagggcggtgacggagctgg

SEQ ID NO: 413133 - DNA, 23 bp, Artificial Sequence
  Description of Artificial Sequence: Synthetic oligonucleotide
tacagggcggtgacggagctggg

SEQ ID NO: 413134 - DNA, 22 bp, Artificial Sequence
  Description of Artificial Sequence: Synthetic oligonucleotide
acagggcggtgacggagctggg

SEQ ID NO: 413135 - DNA, 21 bp, Artificial Sequence
  Description of Artificial Sequence: Synthetic oligonucleotide
cagggcggtgacggagctggg

SEQ ID NO: 413136 - DNA, 21 bp, Artificial Sequence
  Description of Artificial Sequence: Synthetic oligonucleotide
agggcggtgacggagctgggg

SEQ ID NO: 413137 - DNA, 20 bp, Artificial Sequence
  Description of Artificial Sequence: Synthetic oligonucleotide
gtgacggagctggggcggcc

SEQ ID NO: 413138 - DNA, 21 bp, Artificial Sequence
  Description of Artificial Sequence: Synthetic oligonucleotide
tgacggagctggggcggccca

SEQ ID NO: 413139 - DNA, 20 bp, Artificial Sequence
  Description of Artificial Sequence: Synthetic oligonucleotide
gacggagctggggcggccca

SEQ ID NO: 413140 - DNA, 20 bp, Artificial Sequence
  Description of Artificial Sequence: Synthetic oligonucleotide
acggagctggggcggcccag

SEQ ID NO: 413141 - DNA, 20 bp, Artificial Sequence
  Description of Artificial Sequence: Synthetic oligonucleotide
cggagctggggcggcccagt

SEQ ID NO: 413142 - DNA, 20 bp, Artificial Sequence
  Description of Artificial Sequence: Synthetic oligonucleotide
ggagctggggcggcccagct

SEQ ID NO: 413143 - DNA, 20 bp, Artificial Sequence
  Description of Artificial Sequence: Synthetic oligonucleotide
gagctggggcggcccagcgt

SEQ ID NO: 413144 - DNA, 20 bp, Artificial Sequence
  Description of Artificial Sequence: Synthetic oligonucleotide
agctggggcggcccagcgct

SEQ ID NO: 413145 - DNA, 20 bp, Artificial Sequence
  Description of Artificial Sequence: Synthetic oligonucleotide
gctggggcggcccagcgctt

SEQ ID NO: 413146 - DNA, 20 bp, Artificial Sequence
  Description of Artificial Sequence: Synthetic oligonucleotide
ctggggcggcccagcgcctt

SEQ ID NO: 413147 - DNA, 20 bp, Artificial Sequence
  Description of Artificial Sequence: Synthetic oligonucleotide
tggggcggcccagcgccgat

SEQ ID NO: 413148 - DNA, 20 bp, Artificial Sequence
  Description of Artificial Sequence: Synthetic oligonucleotide
ggggcggcccagcgccgatt

SEQ ID NO: 413149 - DNA, 20 bp, Artificial Sequence
  Description of Artificial Sequence: Synthetic oligonucleotide
gggcggcccagcgccgagta

SEQ ID NO: 413150 - DNA, 21 bp, Artificial Sequence
  Description of Artificial Sequence: Synthetic oligonucleotide
ggcggcccagcgccgagtact

SEQ ID NO: 413151 - DNA, 21 bp, Artificial Sequence
  Description of Artificial Sequence: Synthetic oligonucleotide
gcggcccagcgccgagtactg

SEQ ID NO: 413152 - DNA, 23 bp, Artificial Sequence
  Description of Artificial Sequence: Synthetic oligonucleotide
cggcccagcgccgagtactggaa

SEQ ID NO: 413153 - DNA, 24 bp, Artificial Sequence
  Description of Artificial Sequence: Synthetic oligonucleotide
ggcccagcgccgagtactggaaca

SEQ ID NO: 413154 - DNA, 24 bp, Artificial Sequence
  Description of Artificial Sequence: Synthetic oligonucleotide
gcccagcgccgagtactggaacag

SEQ ID NO: 413155 - DNA, 24 bp, Artificial Sequence
  Description of Artificial Sequence: Synthetic oligonucleotide
cccagcgccgagtactggaacagc

SEQ ID NO: 413156 - DNA, 25 bp, Artificial Sequence
  Description of Artificial Sequence: Synthetic oligonucleotide
ccagcgccgagtactggaacagcca

SEQ ID NO: 413157 - DNA, 27 bp, Artificial Sequence
  Description of Artificial Sequence: Synthetic oligonucleotide
cagcgccgagtactggaacagccagaa

SEQ ID NO: 413158 - DNA, 36 bp, Artificial Sequence; identical to SEQ ID NO: 66908
  Description of Artificial Sequence: Synthetic oligonucleotide

SEQ ID NO: 413159 - DNA, 37 bp, Artificial Sequence; identical to SEQ ID NO: 66909
  Description of Artificial Sequence: Synthetic oligonucleotide

SEQ ID NO: 413160 - DNA, 36 bp, Artificial Sequence; identical to SEQ ID NO: 66910
  Description of Artificial Sequence: Synthetic oligonucleotide

SEQ ID NO: 413161 - DNA, 36 bp, Artificial Sequence; identical to SEQ ID NO: 66911
  Description of Artificial Sequence: Synthetic oligonucleotide

SEQ ID NO: 413162 - DNA, 36 bp, Artificial Sequence; identical to SEQ ID NO: 66912
  Description of Artificial Sequence: Synthetic oligonucleotide

SEQ ID NO: 413163 - DNA, 35 bp, Artificial Sequence; identical to SEQ ID NO: 66913
  Description of Artificial Sequence: Synthetic oligonucleotide

SEQ ID NO: 413164 - DNA, 36 bp, Artificial Sequence; identical to SEQ ID NO: 66914
  Description of Artificial Sequence: Synthetic oligonucleotide

SEQ ID NO: 413165 - DNA, 36 bp, Artificial Sequence; identical to SEQ ID NO: 66915
  Description of Artificial Sequence: Synthetic oligonucleotide

SEQ ID NO: 413166 - DNA, 35 bp, Artificial Sequence; identical to SEQ ID NO: 66916
  Description of Artificial Sequence: Synthetic oligonucleotide

SEQ ID NO: 413167 - DNA, 34 bp, Artificial Sequence; identical to SEQ ID NO: 66917
  Description of Artificial Sequence: Synthetic oligonucleotide

SEQ ID NO: 413168 - DNA, 33 bp, Artificial Sequence; identical to SEQ ID NO: 66918
  Description of Artificial Sequence: Synthetic oligonucleotide

SEQ ID NO: 413169 - DNA, 32 bp, Artificial Sequence; identical to SEQ ID NO: 66919
  Description of Artificial Sequence: Synthetic oligonucleotide

SEQ ID NO: 413170 - DNA, 31 bp, Artificial Sequence; identical to SEQ ID NO: 66920
  Description of Artificial Sequence: Synthetic oligonucleotide

SEQ ID NO: 413171 - DNA, 31 bp, Artificial Sequence; identical to SEQ ID NO: 66921
  Description of Artificial Sequence: Synthetic oligonucleotide

SEQ ID NO: 413172 - DNA, 30 bp, Artificial Sequence; identical to SEQ ID NO: 66922
  Description of Artificial Sequence: Synthetic oligonucleotide

SEQ ID NO: 413173 - DNA, 29 bp, Artificial Sequence
  Description of Artificial Sequence: Synthetic oligonucleotide
gagtgtcatttcttcaacggcacggagcg

SEQ ID NO: 413174 - DNA, 29 bp, Artificial Sequence
  Description of Artificial Sequence: Synthetic oligonucleotide
agtgtcatttcttcaacggcacggagcgg

SEQ ID NO: 413175 - DNA, 28 bp, Artificial Sequence
  Description of Artificial Sequence: Synthetic oligonucleotide
gtgtcatttcttcaacggcacggagcgg

SEQ ID NO: 413176 - DNA, 28 bp, Artificial Sequence
  Description of Artificial Sequence: Synthetic oligonucleotide
tgtcatttcttcaacggcacggagcggg

SEQ ID NO: 413177 - DNA, 27 bp, Artificial Sequence
  Description of Artificial Sequence: Synthetic oligonucleotide
gtcatttcttcaacggcacggagcggg

SEQ ID NO: 413178 - DNA, 28 bp, Artificial Sequence
  Description of Artificial Sequence: Synthetic oligonucleotide
tcatttcttcaacggcacggagcgggtg

SEQ ID NO: 413179 - DNA, 27 bp, Artificial Sequence
  Description of Artificial Sequence: Synthetic oligonucleotide
catttcttcaacggcacggagcgggtg

SEQ ID NO: 413180 - DNA, 27 bp, Artificial Sequence
  Description of Artificial Sequence: Synthetic oligonucleotide
atttcttcaacggcacggagcgggtgc

SEQ ID NO: 413181 - DNA, 26 bp, Artificial Sequence
  Description of Artificial Sequence: Synthetic oligonucleotide
tttcttcaacggcacggagcgggtgc

SEQ ID NO: 413182 - DNA, 25 bp, Artificial Sequence
  Description of Artificial Sequence: Synthetic oligonucleotide
ttcttcaacggcacggagcgggtgc

SEQ ID NO: 413183 - DNA, 24 bp, Artificial Sequence
  Description of Artificial Sequence: Synthetic oligonucleotide
tcttcaacggcacggagcgggtgc

SEQ ID NO: 413184 - DNA, 23 bp, Artificial Sequence
  Description of Artificial Sequence: Synthetic oligonucleotide
cttcaacggcacggagcgggtgc

SEQ ID NO: 413185 - DNA, 23 bp, Artificial Sequence
  Description of Artificial Sequence: Synthetic oligonucleotide
ttcaacggcacggagcgggtgcg

SEQ ID NO: 413186 - DNA, 22 bp, Artificial Sequence
  Description of Artificial Sequence: Synthetic oligonucleotide
tcaacggcacggagcgggtgcg

SEQ ID NO: 413187 - DNA, 21 bp, Artificial Sequence
  Description of Artificial Sequence: Synthetic oligonucleotide
caacggcacggagcgggtgcg

SEQ ID NO: 413188 - DNA, 23 bp, Artificial Sequence
  Description of Artificial Sequence: Synthetic oligonucleotide
aacggcacggagcgggtgcggtt

SEQ ID NO: 413189 - DNA, 22 bp, Artificial Sequence
  Description of Artificial Sequence: Synthetic oligonucleotide
acggcacggagcgggtgcggtt

SEQ ID NO: 413190 - DNA, 21 bp, Artificial Sequence
  Description of Artificial Sequence: Synthetic oligonucleotide
cggcacggagcgggtgcggtt

SEQ ID NO: 413191 - DNA, 21 bp, Artificial Sequence
  Description of Artificial Sequence: Synthetic oligonucleotide
ggcacggagcgggtgcggttc

SEQ ID NO: 413192 - DNA, 22 bp, Artificial Sequence
  Description of Artificial Sequence: Synthetic oligonucleotide
gcacggagcgggtgcggttcct

SEQ ID NO: 413193 - DNA, 22 bp, Artificial Sequence
  Description of Artificial Sequence: Synthetic oligonucleotide
cacggagcgggtgcggttcctg

SEQ ID NO: 413194 - DNA, 27 bp, Artificial Sequence
  Description of Artificial Sequence: Synthetic oligonucleotide
gagtacgtgcgcttcgacagcgacgta

SEQ ID NO: 413195 - DNA, 27 bp, Artificial Sequence
  Description of Artificial Sequence: Synthetic oligonucleotide
agtacgtgcgcttcgacagcgacgtag

SEQ ID NO: 413196 - DNA, 26 bp, Artificial Sequence
  Description of Artificial Sequence: Synthetic oligonucleotide
gtacgtgcgcttcgacagcgacgtag

SEQ ID NO: 413197 - DNA, 26 bp, Artificial Sequence
  Description of Artificial Sequence: Synthetic oligonucleotide
tacgtgcgcttcgacagcgacgtagg

SEQ ID NO: 413198 - DNA, 25 bp, Artificial Sequence
  Description of Artificial Sequence: Synthetic oligonucleotide
acgtgcgcttcgacagcgacgtagg

SEQ ID NO: 413199 - DNA, 31 bp, Artificial Sequence
  Description of Artificial Sequence: Synthetic oligonucleotide
cgggtgcggttcctggacagatacttttatc

SEQ ID NO: 413200 - DNA, 32 bp, Artificial Sequence
  Description of Artificial Sequence: Synthetic oligonucleotide
gggtgcggttcctggacagatacttttatcac

SEQ ID NO: 413201 - DNA, 32 bp, Artificial Sequence
  Description of Artificial Sequence: Synthetic oligonucleotide
ggtgcggttcctggacagatacttttatcacc

SEQ ID NO: 413202 - DNA, 34 bp, Artificial Sequence
  Description of Artificial Sequence: Synthetic oligonucleotide
gtgcggttcctggacagatacttttatcaccaag

SEQ ID NO: 413203 - DNA, 35 bp, Artificial Sequence
  Description of Artificial Sequence: Synthetic oligonucleotide
tgcggttcctggacagatacttttatcaccaagag

SEQ ID NO: 413204 - DNA, 34 bp, Artificial Sequence
  Description of Artificial Sequence: Synthetic oligonucleotide
gcggttcctggacagatacttttatcaccaagag

SEQ ID NO: 413205 - DNA, 34 bp, Artificial Sequence
  Description of Artificial Sequence: Synthetic oligonucleotide
cggttcctggacagatacttttatcaccaagagg

SEQ ID NO: 413206 - DNA, 35 bp, Artificial Sequence
  Description of Artificial Sequence: Synthetic oligonucleotide
ggttcctggacagatacttttatcaccaagaggag

SEQ ID NO: 413207 - DNA, 37 bp, Artificial Sequence
  Description of Artificial Sequence: Synthetic oligonucleotide
gttcctggacagatacttttatcaccaagaggagtac

SEQ ID NO: 413208 - DNA, 37 bp, Artificial Sequence
  Description of Artificial Sequence: Synthetic oligonucleotide
ttcctggacagatacttttatcaccaagaggagtacg

SEQ ID NO: 413209 - DNA, 36 bp, Artificial Sequence
  Description of Artificial Sequence: Synthetic oligonucleotide
tcctggacagatacttttatcaccaagaggagtacg

SEQ ID NO: 413210 - DNA, 35 bp, Artificial Sequence
  Description of Artificial Sequence: Synthetic oligonucleotide
cctggacagatacttttatcaccaagaggagtacg

SEQ ID NO: 413211 - DNA, 36 bp, Artificial Sequence
  Description of Artificial Sequence: Synthetic oligonucleotide
ctggacagatacttttatcaccaagaggagtacgtg

SEQ ID NO: 413212 - DNA, 36 bp, Artificial Sequence
  Description of Artificial Sequence: Synthetic oligonucleotide
tggacagatacttttatcaccaagaggagtacgtgc

SEQ ID NO: 413213 - DNA, 35 bp, Artificial Sequence
  Description of Artificial Sequence: Synthetic oligonucleotide
ggacagatacttttatcaccaagaggagtacgtgc

SEQ ID NO: 413214 - DNA, 35 bp, Artificial Sequence
  Description of Artificial Sequence: Synthetic oligonucleotide
gacagatacttttatcaccaagaggagtacgtgcg

SEQ ID NO: 413215 - DNA, 35 bp, Artificial Sequence
  Description of Artificial Sequence: Synthetic oligonucleotide
acagatacttttatcaccaagaggagtacgtgcgc

SEQ ID NO: 413216 - DNA, 34 bp, Artificial Sequence
  Description of Artificial Sequence: Synthetic oligonucleotide
cagatacttttatcaccaagaggagtacgtgcgc

SEQ ID NO: 413217 - DNA, 36 bp, Artificial Sequence
  Description of Artificial Sequence: Synthetic oligonucleotide
agatacttttatcaccaagaggagtacgtgcgcttc

SEQ ID NO: 413218 - DNA, 35 bp, Artificial Sequence
  Description of Artificial Sequence: Synthetic oligonucleotide
gatacttttatcaccaagaggagtacgtgcgcttc

SEQ ID NO: 413219 - DNA, 35 bp, Artificial Sequence
  Description of Artificial Sequence: Synthetic oligonucleotide
atacttttatcaccaagaggagtacgtgcgcttcg

SEQ ID NO: 413220 - DNA, 34 bp, Artificial Sequence
  Description of Artificial Sequence: Synthetic oligonucleotide
tacttttatcaccaagaggagtacgtgcgcttcg

SEQ ID NO: 413221 - DNA, 33 bp, Artificial Sequence
  Description of Artificial Sequence: Synthetic oligonucleotide
acttttatcaccaagaggagtacgtgcgcttcg

SEQ ID NO: 413222 - DNA, 32 bp, Artificial Sequence
  Description of Artificial Sequence: Synthetic oligonucleotide
cttttatcaccaagaggagtacgtgcgcttcg

SEQ ID NO: 413223 - DNA, 33 bp, Artificial Sequence
  Description of Artificial Sequence: Synthetic oligonucleotide
ttttatcaccaagaggagtacgtgcgcttcgac

SEQ ID NO: 413224 - DNA, 32 bp, Artificial Sequence
  Description of Artificial Sequence: Synthetic oligonucleotide
tttatcaccaagaggagtacgtgcgcttcgac

SEQ ID NO: 413225 - DNA, 31 bp, Artificial Sequence
  Description of Artificial Sequence: Synthetic oligonucleotide
ttatcaccaagaggagtacgtgcgcttcgac

SEQ ID NO: 413226 - DNA, 31 bp, Artificial Sequence; identical to SEQ ID NO: 70027
  Description of Artificial Sequence: Synthetic oligonucleotide

SEQ ID NO: 413227 - DNA, 31 bp, Artificial Sequence; identical to SEQ ID NO: 70028
  Description of Artificial Sequence: Synthetic oligonucleotide

SEQ ID NO: 413228 - DNA, 30 bp, Artificial Sequence; identical to SEQ ID NO: 70029
  Description of Artificial Sequence: Synthetic oligonucleotide

SEQ ID NO: 413229 - DNA, 31 bp, Artificial Sequence; identical to SEQ ID NO: 70030
  Description of Artificial Sequence: Synthetic oligonucleotide

SEQ ID NO: 413230 - DNA, 30 bp, Artificial Sequence; identical to SEQ ID NO: 70031
  Description of Artificial Sequence: Synthetic oligonucleotide

SEQ ID NO: 413231 - DNA, 31 bp, Artificial Sequence; identical to SEQ ID NO: 70032
  Description of Artificial Sequence: Synthetic oligonucleotide

SEQ ID NO: 413232 - DNA, 32 bp, Artificial Sequence; identical to SEQ ID NO: 70033
  Description of Artificial Sequence: Synthetic oligonucleotide

SEQ ID NO: 413233 - DNA, 31 bp, Artificial Sequence; identical to SEQ ID NO: 70034
  Description of Artificial Sequence: Synthetic oligonucleotide

SEQ ID NO: 413234 - DNA, 30 bp, Artificial Sequence; identical to SEQ ID NO: 70035
  Description of Artificial Sequence: Synthetic oligonucleotide

SEQ ID NO: 413235 - DNA, 35 bp, Artificial Sequence; identical to SEQ ID NO: 66949
  Description of Artificial Sequence: Synthetic oligonucleotide

SEQ ID NO: 413236 - DNA, 34 bp, Artificial Sequence; identical to SEQ ID NO: 66950
  Description of Artificial Sequence: Synthetic oligonucleotide

SEQ ID NO: 413237 - DNA, 33 bp, Artificial Sequence; identical to SEQ ID NO: 66951
  Description of Artificial Sequence: Synthetic oligonucleotide

SEQ ID NO: 413238 - DNA, 33 bp, Artificial Sequence; identical to SEQ ID NO: 66952
  Description of Artificial Sequence: Synthetic oligonucleotide

SEQ ID NO: 413239 - DNA, 33 bp, Artificial Sequence; identical to SEQ ID NO: 66953
  Description of Artificial Sequence: Synthetic oligonucleotide

SEQ ID NO: 413240 - DNA, 32 bp, Artificial Sequence; identical to SEQ ID NO: 66954
  Description of Artificial Sequence: Synthetic oligonucleotide

SEQ ID NO: 413241 - DNA, 33 bp, Artificial Sequence; identical to SEQ ID NO: 66955
  Description of Artificial Sequence: Synthetic oligonucleotide

SEQ ID NO: 413242 - DNA, 33 bp, Artificial Sequence; identical to SEQ ID NO: 66956
  Description of Artificial Sequence: Synthetic oligonucleotide

SEQ ID NO: 413243 - DNA, 32 bp, Artificial Sequence; identical to SEQ ID NO: 66957
  Description of Artificial Sequence: Synthetic oligonucleotide

SEQ ID NO: 413244 - DNA, 32 bp, Artificial Sequence; identical to SEQ ID NO: 66958
  Description of Artificial Sequence: Synthetic oligonucleotide

SEQ ID NO: 413245 - DNA, 31 bp, Artificial Sequence; identical to SEQ ID NO: 66959
  Description of Artificial Sequence: Synthetic oligonucleotide

SEQ ID NO: 413246 - DNA, 31 bp, Artificial Sequence; identical to SEQ ID NO: 66960
  Description of Artificial Sequence: Synthetic oligonucleotide

SEQ ID NO: 413247 - DNA, 30 bp, Artificial Sequence; identical to SEQ ID NO: 66961
  Description of Artificial Sequence: Synthetic oligonucleotide

SEQ ID NO: 413248 - DNA, 29 bp, Artificial Sequence
  Description of Artificial Sequence: Synthetic oligonucleotide
acttctatcaccaagaggagtccgtgcgc

SEQ ID NO: 413249 - DNA, 28 bp, Artificial Sequence
  Description of Artificial Sequence: Synthetic oligonucleotide
cttctatcaccaagaggagtccgtgcgc

SEQ ID NO: 413250 - DNA, 30 bp, Artificial Sequence; identical to SEQ ID NO: 66964
  Description of Artificial Sequence: Synthetic oligonucleotide

SEQ ID NO: 413251 - DNA, 29 bp, Artificial Sequence
  Description of Artificial Sequence: Synthetic oligonucleotide
tctatcaccaagaggagtccgtgcgcttc

SEQ ID NO: 413252 - DNA, 28 bp, Artificial Sequence
  Description of Artificial Sequence: Synthetic oligonucleotide
ctatcaccaagaggagtccgtgcgcttc

SEQ ID NO: 413253 - DNA, 28 bp, Artificial Sequence
  Description of Artificial Sequence: Synthetic oligonucleotide
tatcaccaagaggagtccgtgcgcttcg

SEQ ID NO: 413254 - DNA, 27 bp, Artificial Sequence
  Description of Artificial Sequence: Synthetic oligonucleotide
atcaccaagaggagtccgtgcgcttcg

SEQ ID NO: 413255 - DNA, 27 bp, Artificial Sequence
  Description of Artificial Sequence: Synthetic oligonucleotide
tcaccaagaggagtccgtgcgcttcga

SEQ ID NO: 413256 - DNA, 26 bp, Artificial Sequence
  Description of Artificial Sequence: Synthetic oligonucleotide
caccaagaggagtccgtgcgcttcga

SEQ ID NO: 413257 - DNA, 28 bp, Artificial Sequence
  Description of Artificial Sequence: Synthetic oligonucleotide
acagtgcagcggcgagtctatcctgaag

SEQ ID NO: 413258 - DNA, 27 bp, Artificial Sequence
  Description of Artificial Sequence: Synthetic oligonucleotide
cagtgcagcggcgagtctatcctgaag

SEQ ID NO: 413259 - DNA, 28 bp, Artificial Sequence
  Description of Artificial Sequence: Synthetic oligonucleotide
agtgcagcggcgagtctatcctgaagtg

SEQ ID NO: 413260 - DNA, 27 bp, Artificial Sequence
  Description of Artificial Sequence: Synthetic oligonucleotide
gtgcagcggcgagtctatcctgaagtg

SEQ ID NO: 413261 - DNA, 28 bp, Artificial Sequence
  Description of Artificial Sequence: Synthetic oligonucleotide
tgcagcggcgagtctatcctgaagtgac

SEQ ID NO: 413262 - DNA, 27 bp, Artificial Sequence
  Description of Artificial Sequence: Synthetic oligonucleotide
gcagcggcgagtctatcctgaagtgac

SEQ ID NO: 413263 - DNA, 28 bp, Artificial Sequence
  Description of Artificial Sequence: Synthetic oligonucleotide
cagcggcgagtctatcctgaagtgactg

SEQ ID NO: 413264 - DNA, 29 bp, Artificial Sequence
  Description of Artificial Sequence: Synthetic oligonucleotide
agcggcgagtctatcctgaagtgactgtg

SEQ ID NO: 413265 - DNA, 28 bp, Artificial Sequence
  Description of Artificial Sequence: Synthetic oligonucleotide
gcggcgagtctatcctgaagtgactgtg

SEQ ID NO: 413266 - DNA, 31 bp, Artificial Sequence; identical to SEQ ID NO: 66980
  Description of Artificial Sequence: Synthetic oligonucleotide

SEQ ID NO: 413267 - DNA, 31 bp, Artificial Sequence; identical to SEQ ID NO: 66981
  Description of Artificial Sequence: Synthetic oligonucleotide

SEQ ID NO: 413268 - DNA, 32 bp, Artificial Sequence; identical to SEQ ID NO: 66982
  Description of Artificial Sequence: Synthetic oligonucleotide

SEQ ID NO: 413269 - DNA, 32 bp, Artificial Sequence; identical to SEQ ID NO: 66983
  Description of Artificial Sequence: Synthetic oligonucleotide

SEQ ID NO: 413270 - DNA, 35 bp, Artificial Sequence; identical to SEQ ID NO: 66984
  Description of Artificial Sequence: Synthetic oligonucleotide

SEQ ID NO: 413271 - DNA, 36 bp, Artificial Sequence; identical to SEQ ID NO: 66985
  Description of Artificial Sequence: Synthetic oligonucleotide

SEQ ID NO: 413272 - DNA, 35 bp, Artificial Sequence; identical to SEQ ID NO: 66986
  Description of Artificial Sequence: Synthetic oligonucleotide

SEQ ID NO: 413273 - DNA, 35 bp, Artificial Sequence; identical to SEQ ID NO: 66987
  Description of Artificial Sequence: Synthetic oligonucleotide

SEQ ID NO: 413274 - DNA, 34 bp, Artificial Sequence; identical to SEQ ID NO: 66988
  Description of Artificial Sequence: Synthetic oligonucleotide

SEQ ID NO: 413275 - DNA, 34 bp, Artificial Sequence; identical to SEQ ID NO: 66989
  Description of Artificial Sequence: Synthetic oligonucleotide

SEQ ID NO: 413276 - DNA, 33 bp, Artificial Sequence; identical to SEQ ID NO: 66990
  Description of Artificial Sequence: Synthetic oligonucleotide

SEQ ID NO: 413277 - DNA, 32 bp, Artificial Sequence; identical to SEQ ID NO: 66991
  Description of Artificial Sequence: Synthetic oligonucleotide

SEQ ID NO: 413278 - DNA, 31 bp, Artificial Sequence; identical to SEQ ID NO: 66992
  Description of Artificial Sequence: Synthetic oligonucleotide

SEQ ID NO: 413279 - DNA, 32 bp, Artificial Sequence; identical to SEQ ID NO: 66993
  Description of Artificial Sequence: Synthetic oligonucleotide

SEQ ID NO: 413280 - DNA, 32 bp, Artificial Sequence; identical to SEQ ID NO: 66994
  Description of Artificial Sequence: Synthetic oligonucleotide

SEQ ID NO: 413281 - DNA, 31 bp, Artificial Sequence; identical to SEQ ID NO: 66995
  Description of Artificial Sequence: Synthetic oligonucleotide

SEQ ID NO: 413282 - DNA, 31 bp, Artificial Sequence; identical to SEQ ID NO: 66996
  Description of Artificial Sequence: Synthetic oligonucleotide

SEQ ID NO: 413283 - DNA, 30 bp, Artificial Sequence; identical to SEQ ID NO: 66997
  Description of Artificial Sequence: Synthetic oligonucleotide

SEQ ID NO: 413284 - DNA, 27 bp, Artificial Sequence
  Description of Artificial Sequence: Synthetic oligonucleotide
agccagaaggacctcctggagcagaga

SEQ ID NO: 413285 - DNA, 26 bp, Artificial Sequence
  Description of Artificial Sequence: Synthetic oligonucleotide
gccagaaggacctcctggagcagaga

SEQ ID NO: 413286 - DNA, 26 bp, Artificial Sequence
  Description of Artificial Sequence: Synthetic oligonucleotide
ccagaaggacctcctggagcagagac

SEQ ID NO: 413287 - DNA, 26 bp, Artificial Sequence
  Description of Artificial Sequence: Synthetic oligonucleotide
cagaaggacctcctggagcagagacg

SEQ ID NO: 413288 - DNA, 26 bp, Artificial Sequence
  Description of Artificial Sequence: Synthetic oligonucleotide
agaaggacctcctggagcagagacgg

SEQ ID NO: 413289 - DNA, 25 bp, Artificial Sequence
  Description of Artificial Sequence: Synthetic oligonucleotide
gaaggacctcctggagcagagacgg

SEQ ID NO: 413290 - DNA, 25 bp, Artificial Sequence
  Description of Artificial Sequence: Synthetic oligonucleotide
aaggacctcctggagcagagacggg

SEQ ID NO: 413291 - DNA, 24 bp, Artificial Sequence
  Description of Artificial Sequence: Synthetic oligonucleotide
aggacctcctggagcagagacggg

SEQ ID NO: 413292 - DNA, 23 bp, Artificial Sequence
  Description of Artificial Sequence: Synthetic oligonucleotide
ggacctcctggagcagagacggg

SEQ ID NO: 413293 - DNA, 23 bp, Artificial Sequence
  Description of Artificial Sequence: Synthetic oligonucleotide
gacctcctggagcagagacgggc

SEQ ID NO: 413294 - DNA, 23 bp, Artificial Sequence
  Description of Artificial Sequence: Synthetic oligonucleotide
acctcctggagcagagacgggcc

SEQ ID NO: 413295 - DNA, 22 bp, Artificial Sequence
  Description of Artificial Sequence: Synthetic oligonucleotide
cctcctggagcagagacgggcc

SEQ ID NO: 413296 - DNA, 23 bp, Artificial Sequence
  Description of Artificial Sequence: Synthetic oligonucleotide
ctcctggagcagagacgggccga

SEQ ID NO: 413297 - DNA, 23 bp, Artificial Sequence
  Description of Artificial Sequence: Synthetic oligonucleotide
tcctggagcagagacgggccgag

SEQ ID NO: 413298 - DNA, 22 bp, Artificial Sequence
  Description of Artificial Sequence: Synthetic oligonucleotide
cctggagcagagacgggccgag

SEQ ID NO: 413299 - DNA, 23 bp, Artificial Sequence
  Description of Artificial Sequence: Synthetic oligonucleotide
ctggagcagagacgggccgaggt

SEQ ID NO: 413300 - DNA, 23 bp, Artificial Sequence
  Description of Artificial Sequence: Synthetic oligonucleotide
tggagcagagacgggccgaggtg

SEQ ID NO: 413301 - DNA, 22 bp, Artificial Sequence
  Description of Artificial Sequence: Synthetic oligonucleotide
ggagcagagacgggccgaggtg

SEQ ID NO: 413302 - DNA, 23 bp, Artificial Sequence
  Description of Artificial Sequence: Synthetic oligonucleotide
gagcagagacgggccgaggtgga

SEQ ID NO: 413303 - DNA, 24 bp, Artificial Sequence
  Description of Artificial Sequence: Synthetic oligonucleotide
agcagagacgggccgaggtggaca

SEQ ID NO: 413304 - DNA, 23 bp, Artificial Sequence
  Description of Artificial Sequence: Synthetic oligonucleotide
gcagagacgggccgaggtggaca

SEQ ID NO: 413305 - DNA, 23 bp, Artificial Sequence
  Description of Artificial Sequence: Synthetic oligonucleotide
cagagacgggccgaggtggacac

SEQ ID NO: 413306 - DNA, 25 bp, Artificial Sequence
  Description of Artificial Sequence: Synthetic oligonucleotide
agagacgggccgaggtggacaccta

SEQ ID NO: 413307 - DNA, 24 bp, Artificial Sequence
  Description of Artificial Sequence: Synthetic oligonucleotide
gagacgggccgaggtggacaccta

SEQ ID NO: 413308 - DNA, 25 bp, Artificial Sequence
  Description of Artificial Sequence: Synthetic oligonucleotide
agacgggccgaggtggacacctact

SEQ ID NO: 413309 - DNA, 24 bp, Artificial Sequence
  Description of Artificial Sequence: Synthetic oligonucleotide
gacgggccgaggtggacacctact

SEQ ID NO: 413310 - DNA, 24 bp, Artificial Sequence
  Description of Artificial Sequence: Synthetic oligonucleotide
acgggccgaggtggacacctactg

SEQ ID NO: 413311 - DNA, 31 bp, Artificial Sequence; identical to SEQ ID NO: 67025
  Description of Artificial Sequence: Synthetic oligonucleotide

SEQ ID NO: 413312 - DNA, 31 bp, Artificial Sequence; identical to SEQ ID NO: 67026
  Description of Artificial Sequence: Synthetic oligonucleotide

SEQ ID NO: 413313 - DNA, 31 bp, Artificial Sequence; identical to SEQ ID NO: 67027
  Description of Artificial Sequence: Synthetic oligonucleotide

SEQ ID NO: 413314 - DNA, 30 bp, Artificial Sequence; identical to SEQ ID NO: 67028
  Description of Artificial Sequence: Synthetic oligonucleotide

SEQ ID NO: 413315 - DNA, 31 bp, Artificial Sequence; identical to SEQ ID NO: 67029
  Description of Artificial Sequence: Synthetic oligonucleotide

SEQ ID NO: 413316 - DNA, 30 bp, Artificial Sequence; identical to SEQ ID NO: 67030
  Description of Artificial Sequence: Synthetic oligonucleotide

SEQ ID NO: 413317 - DNA, 31 bp, Artificial Sequence; identical to SEQ ID NO: 67031
  Description of Artificial Sequence: Synthetic oligonucleotide

SEQ ID NO: 413318 - DNA, 32 bp, Artificial Sequence; identical to SEQ ID NO: 67032
  Description of Artificial Sequence: Synthetic oligonucleotide

SEQ ID NO: 413319 - DNA, 31 bp, Artificial Sequence; identical to SEQ ID NO: 67033
  Description of Artificial Sequence: Synthetic oligonucleotide

SEQ ID NO: 413320 - DNA, 30 bp, Artificial Sequence; identical to SEQ ID NO: 67034
  Description of Artificial Sequence: Synthetic oligonucleotide

SEQ ID NO: 413321 - DNA, 30 bp, Artificial Sequence; identical to SEQ ID NO: 67035
  Description of Artificial Sequence: Synthetic oligonucleotide

SEQ ID NO: 413322 - DNA, 29 bp, Artificial Sequence
  Description of Artificial Sequence: Synthetic oligonucleotide
gcagacacaactatggggttggtgagagc

SEQ ID NO: 413323 - DNA, 31 bp, Artificial Sequence; identical to SEQ ID NO: 67037
  Description of Artificial Sequence: Synthetic oligonucleotide

SEQ ID NO: 413324 - DNA, 32 bp, Artificial Sequence; identical to SEQ ID NO: 67038
  Description of Artificial Sequence: Synthetic oligonucleotide

SEQ ID NO: 413325 - DNA, 31 bp, Artificial Sequence; identical to SEQ ID NO: 67039
  Description of Artificial Sequence: Synthetic oligonucleotide

SEQ ID NO: 413326 - DNA, 32 bp, Artificial Sequence; identical to SEQ ID NO: 67040
  Description of Artificial Sequence: Synthetic oligonucleotide

SEQ ID NO: 413327 - DNA, 31 bp, Artificial Sequence; identical to SEQ ID NO: 67041
  Description of Artificial Sequence: Synthetic oligonucleotide

SEQ ID NO: 413328 - DNA, 32 bp, Artificial Sequence; identical to SEQ ID NO: 67042
  Description of Artificial Sequence: Synthetic oligonucleotide

SEQ ID NO: 413329 - DNA, 31 bp, Artificial Sequence; identical to SEQ ID NO: 67043
  Description of Artificial Sequence: Synthetic oligonucleotide

SEQ ID NO: 413330 - DNA, 31 bp, Artificial Sequence; identical to SEQ ID NO: 67044
  Description of Artificial Sequence: Synthetic oligonucleotide

SEQ ID NO: 413331 - DNA, 30 bp, Artificial Sequence; identical to SEQ ID NO: 67045
  Description of Artificial Sequence: Synthetic oligonucleotide

SEQ ID NO: 413332 - DNA, 29 bp, Artificial Sequence
  Description of Artificial Sequence: Synthetic oligonucleotide
ctatggggttggtgagagcttcacagtgc

SEQ ID NO: 413333 - DNA, 30 bp, Artificial Sequence; identical to SEQ ID NO: 67047
  Description of Artificial Sequence: Synthetic oligonucleotide

SEQ ID NO: 413334 - DNA, 29 bp, Artificial Sequence
  Description of Artificial Sequence: Synthetic oligonucleotide
atggggttggtgagagcttcacagtgcag

SEQ ID NO: 413335 - DNA, 28 bp, Artificial Sequence
  Description of Artificial Sequence: Synthetic oligonucleotide
tggggttggtgagagcttcacagtgcag

SEQ ID NO: 413336 - DNA, 26 bp, Artificial Sequence
  Description of Artificial Sequence: Synthetic oligonucleotide
aaggacatcctggagcagaagcgggc

SEQ ID NO: 413337 - DNA, 25 bp, Artificial Sequence
  Description of Artificial Sequence: Synthetic oligonucleotide
aggacatcctggagcagaagcgggc

SEQ ID NO: 413338 - DNA, 24 bp, Artificial Sequence
  Description of Artificial Sequence: Synthetic oligonucleotide
ggacatcctggagcagaagcgggc

SEQ ID NO: 413339 - DNA, 24 bp, Artificial Sequence
  Description of Artificial Sequence: Synthetic oligonucleotide
gacatcctggagcagaagcgggcc

SEQ ID NO: 413340 - DNA, 25 bp, Artificial Sequence
  Description of Artificial Sequence: Synthetic oligonucleotide
acatcctggagcagaagcgggccga

SEQ ID NO: 413341 - DNA, 24 bp, Artificial Sequence
  Description of Artificial Sequence: Synthetic oligonucleotide
catcctggagcagaagcgggccga

SEQ ID NO: 413342 - DNA, 24 bp, Artificial Sequence
  Description of Artificial Sequence: Synthetic oligonucleotide
atcctggagcagaagcgggccgag

SEQ ID NO: 413343 - DNA, 23 bp, Artificial Sequence
  Description of Artificial Sequence: Synthetic oligonucleotide
tcctggagcagaagcgggccgag

SEQ ID NO: 413344 - DNA, 22 bp, Artificial Sequence
  Description of Artificial Sequence: Synthetic oligonucleotide
cctggagcagaagcgggccgag

SEQ ID NO: 413345 - DNA, 23 bp, Artificial Sequence
  Description of Artificial Sequence: Synthetic oligonucleotide
ctggagcagaagcgggccgaggt

SEQ ID NO: 413346 - DNA, 23 bp, Artificial Sequence
  Description of Artificial Sequence: Synthetic oligonucleotide
tggagcagaagcgggccgaggtg

SEQ ID NO: 413347 - DNA, 22 bp, Artificial Sequence
  Description of Artificial Sequence: Synthetic oligonucleotide
ggagcagaagcgggccgaggtg

SEQ ID NO: 413348 - DNA, 23 bp, Artificial Sequence
  Description of Artificial Sequence: Synthetic oligonucleotide
gagcagaagcgggccgaggtgga

SEQ ID NO: 413349 - DNA, 24 bp, Artificial Sequence
  Description of Artificial Sequence: Synthetic oligonucleotide
agcagaagcgggccgaggtggaca

SEQ ID NO: 413350 - DNA, 23 bp, Artificial Sequence
  Description of Artificial Sequence: Synthetic oligonucleotide
gcagaagcgggccgaggtggaca

SEQ ID NO: 413351 - DNA, 23 bp, Artificial Sequence
  Description of Artificial Sequence: Synthetic oligonucleotide
cagaagcgggccgaggtggacac

SEQ ID NO: 413352 - DNA, 25 bp, Artificial Sequence
  Description of Artificial Sequence: Synthetic oligonucleotide
agaagcgggccgaggtggacaccta

SEQ ID NO: 413353 - DNA, 24 bp, Artificial Sequence
  Description of Artificial Sequence: Synthetic oligonucleotide
gaagcgggccgaggtggacaccta

SEQ ID NO: 413354 - DNA, 25 bp, Artificial Sequence
  Description of Artificial Sequence: Synthetic oligonucleotide
aagcgggccgaggtggacacctact

SEQ ID NO: 413355 - DNA, 24 bp, Artificial Sequence
  Description of Artificial Sequence: Synthetic oligonucleotide
agcgggccgaggtggacacctact

SEQ ID NO: 413356 - DNA, 20 bp, Artificial Sequence
  Description of Artificial Sequence: Synthetic oligonucleotide
ctggagcggaggcgggccga

SEQ ID NO: 413357 - DNA, 20 bp, Artificial Sequence
  Description of Artificial Sequence: Synthetic oligonucleotide
tggagcggaggcgggccgag

SEQ ID NO: 413358 - DNA, 20 bp, Artificial Sequence
  Description of Artificial Sequence: Synthetic oligonucleotide
ggagcggaggcgggccgagt

SEQ ID NO: 413359 - DNA, 20 bp, Artificial Sequence
  Description of Artificial Sequence: Synthetic oligonucleotide
gagcggaggcgggccgaggt

SEQ ID NO: 413360 - DNA, 20 bp, Artificial Sequence
  Description of Artificial Sequence: Synthetic oligonucleotide
agcggaggcgggccgaggtg

SEQ ID NO: 413361 - DNA, 20 bp, Artificial Sequence
  Description of Artificial Sequence: Synthetic oligonucleotide
gcggaggcgggccgaggtgt

SEQ ID NO: 413362 - DNA, 20 bp, Artificial Sequence
  Description of Artificial Sequence: Synthetic oligonucleotide
cggaggcgggccgaggtgga

SEQ ID NO: 413363 - DNA, 21 bp, Artificial Sequence
  Description of Artificial Sequence: Synthetic oligonucleotide
ggaggcgggccgaggtggaca

SEQ ID NO: 413364 - DNA, 36 bp, Artificial Sequence; identical to SEQ ID NO: 67368
  Description of Artificial Sequence: Synthetic oligonucleotide

SEQ ID NO: 413365 - DNA, 35 bp, Artificial Sequence; identical to SEQ ID NO: 67369
  Description of Artificial Sequence: Synthetic oligonucleotide

SEQ ID NO: 413366 - DNA, 34 bp, Artificial Sequence; identical to SEQ ID NO: 67370
  Description of Artificial Sequence: Synthetic oligonucleotide

SEQ ID NO: 413367 - DNA, 34 bp, Artificial Sequence; identical to SEQ ID NO: 67371
  Description of Artificial Sequence: Synthetic oligonucleotide

SEQ ID NO: 413368 - DNA, 35 bp, Artificial Sequence; identical to SEQ ID NO: 67372
  Description of Artificial Sequence: Synthetic oligonucleotide

SEQ ID NO: 413369 - DNA, 34 bp, Artificial Sequence; identical to SEQ ID NO: 67373
  Description of Artificial Sequence: Synthetic oligonucleotide

SEQ ID NO: 413370 - DNA, 34 bp, Artificial Sequence; identical to SEQ ID NO: 67374
  Description of Artificial Sequence: Synthetic oligonucleotide

SEQ ID NO: 413371 - DNA, 34 bp, Artificial Sequence; identical to SEQ ID NO: 67375
  Description of Artificial Sequence: Synthetic oligonucleotide

SEQ ID NO: 413372 - DNA, 33 bp, Artificial Sequence; identical to SEQ ID NO: 67376
  Description of Artificial Sequence: Synthetic oligonucleotide

SEQ ID NO: 413373 - DNA, 33 bp, Artificial Sequence; identical to SEQ ID NO: 67377
  Description of Artificial Sequence: Synthetic oligonucleotide

SEQ ID NO: 413374 - DNA, 32 bp, Artificial Sequence; identical to SEQ ID NO: 67378
  Description of Artificial Sequence: Synthetic oligonucleotide

SEQ ID NO: 413375 - DNA, 34 bp, Artificial Sequence; identical to SEQ ID NO: 67379
  Description of Artificial Sequence: Synthetic oligonucleotide

SEQ ID NO: 413376 - DNA, 33 bp, Artificial Sequence; identical to SEQ ID NO: 67380
  Description of Artificial Sequence: Synthetic oligonucleotide

SEQ ID NO: 413377 - DNA, 32 bp, Artificial Sequence; identical to SEQ ID NO: 67381
  Description of Artificial Sequence: Synthetic oligonucleotide

SEQ ID NO: 413378 - DNA, 31 bp, Artificial Sequence; identical to SEQ ID NO: 67382
  Description of Artificial Sequence: Synthetic oligonucleotide

SEQ ID NO: 413379 - DNA, 31 bp, Artificial Sequence; identical to SEQ ID NO: 67383
  Description of Artificial Sequence: Synthetic oligonucleotide

SEQ ID NO: 413380 - DNA, 30 bp, Artificial Sequence; identical to SEQ ID NO: 67384
  Description of Artificial Sequence: Synthetic oligonucleotide

SEQ ID NO: 413381 - DNA, 29 bp, Artificial Sequence
  Description of Artificial Sequence: Synthetic oligonucleotide
ctatcaccaagaggagaacgtgcgcttcg

SEQ ID NO: 413382 - DNA, 30 bp, Artificial Sequence; identical to SEQ ID NO: 67386
  Description of Artificial Sequence: Synthetic oligonucleotide

SEQ ID NO: 413383 - DNA, 29 bp, Artificial Sequence
  Description of Artificial Sequence: Synthetic oligonucleotide
atcaccaagaggagaacgtgcgcttcgac

SEQ ID NO: 413384 - DNA, 28 bp, Artificial Sequence
  Description of Artificial Sequence: Synthetic oligonucleotide
tcaccaagaggagaacgtgcgcttcgac

SEQ ID NO: 413385 - DNA, 27 bp, Artificial Sequence
  Description of Artificial Sequence: Synthetic oligonucleotide
caccaagaggagaacgtgcgcttcgac

SEQ ID NO: 413386 - DNA, 30 bp, Artificial Sequence; identical to SEQ ID NO: 67050
  Description of Artificial Sequence: Synthetic oligonucleotide

SEQ ID NO: 413387 - DNA, 30 bp, Artificial Sequence; identical to SEQ ID NO: 67051
  Description of Artificial Sequence: Synthetic oligonucleotide

SEQ ID NO: 413388 - DNA, 29 bp, Artificial Sequence
  Description of Artificial Sequence: Synthetic oligonucleotide
acagccagaaggacatcctggaagacagg

SEQ ID NO: 413389 - DNA, 28 bp, Artificial Sequence
  Description of Artificial Sequence: Synthetic oligonucleotide
cagccagaaggacatcctggaagacagg

SEQ ID NO: 413390 - DNA, 28 bp, Artificial Sequence
  Description of Artificial Sequence: Synthetic oligonucleotide
agccagaaggacatcctggaagacaggc

SEQ ID NO: 413391 - DNA, 27 bp, Artificial Sequence
  Description of Artificial Sequence: Synthetic oligonucleotide
gccagaaggacatcctggaagacaggc

SEQ ID NO: 413392 - DNA, 27 bp, Artificial Sequence
  Description of Artificial Sequence: Synthetic oligonucleotide
ccagaaggacatcctggaagacaggcg

SEQ ID NO: 413393 - DNA, 27 bp, Artificial Sequence
  Description of Artificial Sequence: Synthetic oligonucleotide
cagaaggacatcctggaagacaggcgg

SEQ ID NO: 413394 - DNA, 27 bp, Artificial Sequence
  Description of Artificial Sequence: Synthetic oligonucleotide
agaaggacatcctggaagacaggcggg

SEQ ID NO: 413395 - DNA, 26 bp, Artificial Sequence
  Description of Artificial Sequence: Synthetic oligonucleotide
gaaggacatcctggaagacaggcggg

SEQ ID NO: 413396 - DNA, 26 bp, Artificial Sequence
  Description of Artificial Sequence: Synthetic oligonucleotide
aaggacatcctggaagacaggcgggc

SEQ ID NO: 413397 - DNA, 25 bp, Artificial Sequence
  Description of Artificial Sequence: Synthetic oligonucleotide
aggacatcctggaagacaggcgggc

SEQ ID NO: 413398 - DNA, 24 bp, Artificial Sequence
  Description of Artificial Sequence: Synthetic oligonucleotide
ggacatcctggaagacaggcgggc

SEQ ID NO: 413399 - DNA, 24 bp, Artificial Sequence
  Description of Artificial Sequence: Synthetic oligonucleotide
gacatcctggaagacaggcgggcc

SEQ ID NO: 413400 - DNA, 25 bp, Artificial Sequence
  Description of Artificial Sequence: Synthetic oligonucleotide
acatcctggaagacaggcgggccct

SEQ ID NO: 413401 - DNA, 24 bp, Artificial Sequence
  Description of Artificial Sequence: Synthetic oligonucleotide
catcctggaagacaggcgggccct

SEQ ID NO: 413402 - DNA, 24 bp, Artificial Sequence
  Description of Artificial Sequence: Synthetic oligonucleotide
atcctggaagacaggcgggccctg

SEQ ID NO: 413403 - DNA, 23 bp, Artificial Sequence
  Description of Artificial Sequence: Synthetic oligonucleotide
tcctggaagacaggcgggccctg

SEQ ID NO: 413404 - DNA, 22 bp, Artificial Sequence
  Description of Artificial Sequence: Synthetic oligonucleotide
cctggaagacaggcgggccctg

SEQ ID NO: 413405 - DNA, 23 bp, Artificial Sequence
  Description of Artificial Sequence: Synthetic oligonucleotide
ctggaagacaggcgggccctggt

SEQ ID NO: 413406 - DNA, 23 bp, Artificial Sequence
  Description of Artificial Sequence: Synthetic oligonucleotide
tggaagacaggcgggccctggtg

SEQ ID NO: 413407 - DNA, 22 bp, Artificial Sequence
  Description of Artificial Sequence: Synthetic oligonucleotide
ggaagacaggcgggccctggtg

SEQ ID NO: 413408 - DNA, 23 bp, Artificial Sequence
  Description of Artificial Sequence: Synthetic oligonucleotide
gaagacaggcgggccctggtgga

SEQ ID NO: 413409 - DNA, 24 bp, Artificial Sequence
  Description of Artificial Sequence: Synthetic oligonucleotide
aagacaggcgggccctggtggaca

SEQ ID NO: 413410 - DNA, 23 bp, Artificial Sequence
  Description of Artificial Sequence: Synthetic oligonucleotide
agacaggcgggccctggtggaca

SEQ ID NO: 413411 - DNA, 22 bp, Artificial Sequence
  Description of Artificial Sequence: Synthetic oligonucleotide
gacaggcgggccctggtggaca

SEQ ID NO: 413412 - DNA, 22 bp, Artificial Sequence
  Description of Artificial Sequence: Synthetic oligonucleotide
acaggcgggccctggtggacac

SEQ ID NO: 413413 - DNA, 21 bp, Artificial Sequence
  Description of Artificial Sequence: Synthetic oligonucleotide
caggcgggccctggtggacac

SEQ ID NO: 413414 - DNA, 23 bp, Artificial Sequence
  Description of Artificial Sequence: Synthetic oligonucleotide
aggcgggccctggtggacaccta

SEQ ID NO: 413415 - DNA, 22 bp, Artificial Sequence
  Description of Artificial Sequence: Synthetic oligonucleotide
ggcgggccctggtggacaccta

SEQ ID NO: 413416 - DNA, 23 bp, Artificial Sequence
  Description of Artificial Sequence: Synthetic oligonucleotide
gcgggccctggtggacacctact

SEQ ID NO: 413417 - DNA, 23 bp, Artificial Sequence
  Description of Artificial Sequence: Synthetic oligonucleotide
cgggccctggtggacacctactg

SEQ ID NO: 413418 - DNA, 24 bp, Artificial Sequence
  Description of Artificial Sequence: Synthetic oligonucleotide
gggccctggtggacacctactgca

SEQ ID NO: 413419 - DNA, 25 bp, Artificial Sequence
  Description of Artificial Sequence: Synthetic oligonucleotide
ggccctggtggacacctactgcaga

SEQ ID NO: 413420 - DNA, 26 bp, Artificial Sequence
  Description of Artificial Sequence: Synthetic oligonucleotide
gccctggtggacacctactgcagaca

SEQ ID NO: 413421 - DNA, 27 bp, Artificial Sequence
  Description of Artificial Sequence: Synthetic oligonucleotide
ccctggtggacacctactgcagacaca

SEQ ID NO: 413422 - DNA, 28 bp, Artificial Sequence
  Description of Artificial Sequence: Synthetic oligonucleotide
cctggtggacacctactgcagacacaac

SEQ ID NO: 413423 - DNA, 30 bp, Artificial Sequence; identical to SEQ ID NO: 67087
  Description of Artificial Sequence: Synthetic oligonucleotide

SEQ ID NO: 413424 - DNA, 30 bp, Artificial Sequence; identical to SEQ ID NO: 67088
  Description of Artificial Sequence: Synthetic oligonucleotide

SEQ ID NO: 413425 - DNA, 31 bp, Artificial Sequence; identical to SEQ ID NO: 67089
  Description of Artificial Sequence: Synthetic oligonucleotide

SEQ ID NO: 413426 - DNA, 30 bp, Artificial Sequence; identical to SEQ ID NO: 67090
  Description of Artificial Sequence: Synthetic oligonucleotide

SEQ ID NO: 413427 - DNA, 29 bp, Artificial Sequence
  Description of Artificial Sequence: Synthetic oligonucleotide
ctggaacagccagaaggacttcctggaag

SEQ ID NO: 413428 - DNA, 30 bp, Artificial Sequence; identical to SEQ ID NO: 67092
  Description of Artificial Sequence: Synthetic oligonucleotide

SEQ ID NO: 413429 - DNA, 29 bp, Artificial Sequence
  Description of Artificial Sequence: Synthetic oligonucleotide
ggaacagccagaaggacttcctggaagac

SEQ ID NO: 413430 - DNA, 30 bp, Artificial Sequence; identical to SEQ ID NO: 67094
  Description of Artificial Sequence: Synthetic oligonucleotide

SEQ ID NO: 413431 - DNA, 30 bp, Artificial Sequence; identical to SEQ ID NO: 67095
  Description of Artificial Sequence: Synthetic oligonucleotide

SEQ ID NO: 413432 - DNA, 29 bp, Artificial Sequence
  Description of Artificial Sequence: Synthetic oligonucleotide
acagccagaaggacttcctggaagacagg

SEQ ID NO: 413433 - DNA, 28 bp, Artificial Sequence
  Description of Artificial Sequence: Synthetic oligonucleotide
cagccagaaggacttcctggaagacagg

SEQ ID NO: 413434 - DNA, 28 bp, Artificial Sequence
  Description of Artificial Sequence: Synthetic oligonucleotide
agccagaaggacttcctggaagacaggc

SEQ ID NO: 413435 - DNA, 27 bp, Artificial Sequence
  Description of Artificial Sequence: Synthetic oligonucleotide
gccagaaggacttcctggaagacaggc

SEQ ID NO: 413436 - DNA, 27 bp, Artificial Sequence
  Description of Artificial Sequence: Synthetic oligonucleotide
ccagaaggacttcctggaagacaggcg

SEQ ID NO: 413437 - DNA, 27 bp, Artificial Sequence
  Description of Artificial Sequence: Synthetic oligonucleotide
cagaaggacttcctggaagacaggcgg

SEQ ID NO: 413438 - DNA, 27 bp, Artificial Sequence
  Description of Artificial Sequence: Synthetic oligonucleotide
agaaggacttcctggaagacaggcggg

SEQ ID NO: 413439 - DNA, 26 bp, Artificial Sequence
  Description of Artificial Sequence: Synthetic oligonucleotide
gaaggacttcctggaagacaggcggg

SEQ ID NO: 413440 - DNA, 26 bp, Artificial Sequence
  Description of Artificial Sequence: Synthetic oligonucleotide
aaggacttcctggaagacaggcgggc

SEQ ID NO: 413441 - DNA, 25 bp, Artificial Sequence
  Description of Artificial Sequence: Synthetic oligonucleotide
aggacttcctggaagacaggcgggc

SEQ ID NO: 413442 - DNA, 24 bp, Artificial Sequence
  Description of Artificial Sequence: Synthetic oligonucleotide
ggacttcctggaagacaggcgggc

SEQ ID NO: 413443 - DNA, 24 bp, Artificial Sequence
  Description of Artificial Sequence: Synthetic oligonucleotide
gacttcctggaagacaggcgggcc

SEQ ID NO: 413444 - DNA, 24 bp, Artificial Sequence
  Description of Artificial Sequence: Synthetic oligonucleotide
acttcctggaagacaggcgggccg

SEQ ID NO: 413445 - DNA, 23 bp, Artificial Sequence
  Description of Artificial Sequence: Synthetic oligonucleotide
cttcctggaagacaggcgggccg

SEQ ID NO: 413446 - DNA, 23 bp, Artificial Sequence
  Description of Artificial Sequence: Synthetic oligonucleotide
ttcctggaagacaggcgggccgc

SEQ ID NO: 413447 - DNA, 22 bp, Artificial Sequence
  Description of Artificial Sequence: Synthetic oligonucleotide
tcctggaagacaggcgggccgc

SEQ ID NO: 413448 - DNA, 21 bp, Artificial Sequence
  Description of Artificial Sequence: Synthetic oligonucleotide
cctggaagacaggcgggccgc

SEQ ID NO: 413449 - DNA, 21 bp, Artificial Sequence
  Description of Artificial Sequence: Synthetic oligonucleotide
ctggaagacaggcgggccgcg

SEQ ID NO: 413450 - DNA, 22 bp, Artificial Sequence
  Description of Artificial Sequence: Synthetic oligonucleotide
tggaagacaggcgggccgcggt

SEQ ID NO: 413451 - DNA, 21 bp, Artificial Sequence
  Description of Artificial Sequence: Synthetic oligonucleotide
ggaagacaggcgggccgcggt

SEQ ID NO: 413452 - DNA, 21 bp, Artificial Sequence
  Description of Artificial Sequence: Synthetic oligonucleotide
gaagacaggcgggccgcggtg

SEQ ID NO: 413453 - DNA, 22 bp, Artificial Sequence
  Description of Artificial Sequence: Synthetic oligonucleotide
aagacaggcgggccgcggtgga

SEQ ID NO: 413454 - DNA, 21 bp, Artificial Sequence
  Description of Artificial Sequence: Synthetic oligonucleotide
agacaggcgggccgcggtgga

SEQ ID NO: 413455 - DNA, 20 bp, Artificial Sequence
  Description of Artificial Sequence: Synthetic oligonucleotide
gacaggcgggccgcggtgga

SEQ ID NO: 413456 - DNA, 21 bp, Artificial Sequence
  Description of Artificial Sequence: Synthetic oligonucleotide
acaggcgggccgcggtggaca

SEQ ID NO: 413457 - DNA, 20 bp, Artificial Sequence
  Description of Artificial Sequence: Synthetic oligonucleotide
caggcgggccgcggtggaca

SEQ ID NO: 413458 - DNA, 31 bp, Artificial Sequence; identical to SEQ ID NO: 67143
  Description of Artificial Sequence: Synthetic oligonucleotide

SEQ ID NO: 413459 - DNA, 32 bp, Artificial Sequence; identical to SEQ ID NO: 67144
  Description of Artificial Sequence: Synthetic oligonucleotide

SEQ ID NO: 413460 - DNA, 31 bp, Artificial Sequence; identical to SEQ ID NO: 67145
  Description of Artificial Sequence: Synthetic oligonucleotide

SEQ ID NO: 413461 - DNA, 32 bp, Artificial Sequence; identical to SEQ ID NO: 67146
  Description of Artificial Sequence: Synthetic oligonucleotide

SEQ ID NO: 413462 - DNA, 31 bp, Artificial Sequence; identical to SEQ ID NO: 67147
  Description of Artificial Sequence: Synthetic oligonucleotide

SEQ ID NO: 413463 - DNA, 32 bp, Artificial Sequence; identical to SEQ ID NO: 67148
  Description of Artificial Sequence: Synthetic oligonucleotide

SEQ ID NO: 413464 - DNA, 31 bp, Artificial Sequence; identical to SEQ ID NO: 67149
  Description of Artificial Sequence: Synthetic oligonucleotide

SEQ ID NO: 413465 - DNA, 31 bp, Artificial Sequence; identical to SEQ ID NO: 67150
  Description of Artificial Sequence: Synthetic oligonucleotide

SEQ ID NO: 413466 - DNA, 30 bp, Artificial Sequence; identical to SEQ ID NO: 67151
  Description of Artificial Sequence: Synthetic oligonucleotide

SEQ ID NO: 413467 - DNA, 29 bp, Artificial Sequence
  Description of Artificial Sequence: Synthetic oligonucleotide
ctacggggttgtggagagattcacagtgc

SEQ ID NO: 413468 - DNA, 30 bp, Artificial Sequence; identical to SEQ ID NO: 67153
  Description of Artificial Sequence: Synthetic oligonucleotide

SEQ ID NO: 413469 - DNA, 29 bp, Artificial Sequence
  Description of Artificial Sequence: Synthetic oligonucleotide
acggggttgtggagagattcacagtgcag

SEQ ID NO: 413470 - DNA, 28 bp, Artificial Sequence
  Description of Artificial Sequence: Synthetic oligonucleotide
cggggttgtggagagattcacagtgcag

SEQ ID NO: 413471 - DNA, 28 bp, Artificial Sequence
  Description of Artificial Sequence: Synthetic oligonucleotide
ggggttgtggagagattcacagtgcagc

SEQ ID NO: 413472 - DNA, 28 bp, Artificial Sequence
  Description of Artificial Sequence: Synthetic oligonucleotide
gggttgtggagagattcacagtgcagcg

SEQ ID NO: 413473 - DNA, 28 bp, Artificial Sequence
  Description of Artificial Sequence: Synthetic oligonucleotide
ggttgtggagagattcacagtgcagcgg

SEQ ID NO: 413474 - DNA, 28 bp, Artificial Sequence
  Description of Artificial Sequence: Synthetic oligonucleotide
gttgtggagagattcacagtgcagcggc

SEQ ID NO: 413475 - DNA, 28 bp, Artificial Sequence
  Description of Artificial Sequence: Synthetic oligonucleotide
ttgtggagagattcacagtgcagcggcg

SEQ ID NO: 413476 - DNA, 27 bp, Artificial Sequence
  Description of Artificial Sequence: Synthetic oligonucleotide
tgtggagagattcacagtgcagcggcg

SEQ ID NO: 413477 - DNA, 27 bp, Artificial Sequence
  Description of Artificial Sequence: Synthetic oligonucleotide
gtggagagattcacagtgcagcggcga

SEQ ID NO: 413478 - DNA, 27 bp, Artificial Sequence
  Description of Artificial Sequence: Synthetic oligonucleotide
tggagagattcacagtgcagcggcgag

SEQ ID NO: 413479 - DNA, 25 bp, Artificial Sequence
  Description of Artificial Sequence: Synthetic oligonucleotide
acttcctggaagacaggcgggccct

SEQ ID NO: 413480 - DNA, 24 bp, Artificial Sequence
  Description of Artificial Sequence: Synthetic oligonucleotide
cttcctggaagacaggcgggccct

SEQ ID NO: 413481 - DNA, 24 bp, Artificial Sequence
  Description of Artificial Sequence: Synthetic oligonucleotide
ttcctggaagacaggcgggccctg

SEQ ID NO: 413482 - DNA, 24 bp, Artificial Sequence
  Description of Artificial Sequence: Synthetic oligonucleotide
tgacggagctggggcggcctgata

SEQ ID NO: 413483 - DNA, 23 bp, Artificial Sequence
  Description of Artificial Sequence: Synthetic oligonucleotide
gacggagctggggcggcctgata

SEQ ID NO: 413484 - DNA, 23 bp, Artificial Sequence
  Description of Artificial Sequence: Synthetic oligonucleotide
acggagctggggcggcctgatac

SEQ ID NO: 413485 - DNA, 22 bp, Artificial Sequence
  Description of Artificial Sequence: Synthetic oligonucleotide
cggagctggggcggcctgatac

SEQ ID NO: 413486 - DNA, 22 bp, Artificial Sequence
  Description of Artificial Sequence: Synthetic oligonucleotide
ggagctggggcggcctgatacc

SEQ ID NO: 413487 - DNA, 23 bp, Artificial Sequence
  Description of Artificial Sequence: Synthetic oligonucleotide
gagctggggcggcctgataccga

SEQ ID NO: 413488 - DNA, 25 bp, Artificial Sequence
  Description of Artificial Sequence: Synthetic oligonucleotide
agctggggcggcctgataccgagta

SEQ ID NO: 413489 - DNA, 24 bp, Artificial Sequence
  Description of Artificial Sequence: Synthetic oligonucleotide
gctggggcggcctgataccgagta

SEQ ID NO: 413490 - DNA, 25 bp, Artificial Sequence
  Description of Artificial Sequence: Synthetic oligonucleotide
ctggggcggcctgataccgagtact

SEQ ID NO: 413491 - DNA, 25 bp, Artificial Sequence
  Description of Artificial Sequence: Synthetic oligonucleotide
tggggcggcctgataccgagtactg

SEQ ID NO: 413492 - DNA, 24 bp, Artificial Sequence
  Description of Artificial Sequence: Synthetic oligonucleotide
ggggcggcctgataccgagtactg

SEQ ID NO: 413493 - DNA, 26 bp, Artificial Sequence
  Description of Artificial Sequence: Synthetic oligonucleotide
gggcggcctgataccgagtactggaa

SEQ ID NO: 413494 - DNA, 27 bp, Artificial Sequence
  Description of Artificial Sequence: Synthetic oligonucleotide
ggcggcctgataccgagtactggaaca

SEQ ID NO: 413495 - DNA, 27 bp, Artificial Sequence
  Description of Artificial Sequence: Synthetic oligonucleotide
gcggcctgataccgagtactggaacag

SEQ ID NO: 413496 - DNA, 27 bp, Artificial Sequence
  Description of Artificial Sequence: Synthetic oligonucleotide
cggcctgataccgagtactggaacagc

SEQ ID NO: 413497 - DNA, 27 bp, Artificial Sequence
  Description of Artificial Sequence: Synthetic oligonucleotide
ggcctgataccgagtactggaacagcc

SEQ ID NO: 413498 - DNA, 28 bp, Artificial Sequence
  Description of Artificial Sequence: Synthetic oligonucleotide
gcctgataccgagtactggaacagccag

SEQ ID NO: 413499 - DNA, 30 bp, Artificial Sequence; identical to SEQ ID NO: 67186
  Description of Artificial Sequence: Synthetic oligonucleotide

SEQ ID NO: 413500 - DNA, 30 bp, Artificial Sequence; identical to SEQ ID NO: 67187
  Description of Artificial Sequence: Synthetic oligonucleotide

SEQ ID NO: 413501 - DNA, 31 bp, Artificial Sequence; identical to SEQ ID NO: 67188
  Description of Artificial Sequence: Synthetic oligonucleotide

SEQ ID NO: 413502 - DNA, 30 bp, Artificial Sequence; identical to SEQ ID NO: 67189
  Description of Artificial Sequence: Synthetic oligonucleotide

SEQ ID NO: 413503 - DNA, 30 bp, Artificial Sequence; identical to SEQ ID NO: 67190
  Description of Artificial Sequence: Synthetic oligonucleotide

SEQ ID NO: 413504 - DNA, 29 bp, Artificial Sequence
  Description of Artificial Sequence: Synthetic oligonucleotide
taccgagtactggaacagccagaaggacc

SEQ ID NO: 413505 - DNA, 28 bp, Artificial Sequence
  Description of Artificial Sequence: Synthetic oligonucleotide
accgagtactggaacagccagaaggacc

SEQ ID NO: 413506 - DNA, 28 bp, Artificial Sequence
  Description of Artificial Sequence: Synthetic oligonucleotide
acacctactgcagacacaactacggggc

SEQ ID NO: 413507 - DNA, 27 bp, Artificial Sequence
  Description of Artificial Sequence: Synthetic oligonucleotide
cacctactgcagacacaactacggggc

SEQ ID NO: 413508 - DNA, 28 bp, Artificial Sequence
  Description of Artificial Sequence: Synthetic oligonucleotide
acctactgcagacacaactacggggctg

SEQ ID NO: 413509 - DNA, 27 bp, Artificial Sequence
  Description of Artificial Sequence: Synthetic oligonucleotide
cctactgcagacacaactacggggctg

SEQ ID NO: 413510 - DNA, 23 bp, Artificial Sequence
  Description of Artificial Sequence: Synthetic oligonucleotide
ggtgatggagctggggcggccta

SEQ ID NO: 413511 - DNA, 23 bp, Artificial Sequence
  Description of Artificial Sequence: Synthetic oligonucleotide
gtgatggagctggggcggcctag

SEQ ID NO: 413512 - DNA, 23 bp, Artificial Sequence
  Description of Artificial Sequence: Synthetic oligonucleotide
tgatggagctggggcggcctagc

SEQ ID NO: 413513 - DNA, 22 bp, Artificial Sequence
  Description of Artificial Sequence: Synthetic oligonucleotide
gatggagctggggcggcctagc

SEQ ID NO: 413514 - DNA, 22 bp, Artificial Sequence
  Description of Artificial Sequence: Synthetic oligonucleotide
atggagctggggcggcctagcg

SEQ ID NO: 413515 - DNA, 21 bp, Artificial Sequence
  Description of Artificial Sequence: Synthetic oligonucleotide
tggagctggggcggcctagcg

SEQ ID NO: 413516 - DNA, 23 bp, Artificial Sequence
  Description of Artificial Sequence: Synthetic oligonucleotide
agcgacgtgggggagtaccgggt

SEQ ID NO: 413517 - DNA, 22 bp, Artificial Sequence
  Description of Artificial Sequence: Synthetic oligonucleotide
gcgacgtgggggagtaccgggt

SEQ ID NO: 413518 - DNA, 22 bp, Artificial Sequence
  Description of Artificial Sequence: Synthetic oligonucleotide
cgacgtgggggagtaccgggtg

SEQ ID NO: 413519 - DNA, 23 bp, Artificial Sequence
  Description of Artificial Sequence: Synthetic oligonucleotide
gacgtgggggagtaccgggtggt

SEQ ID NO: 413520 - DNA, 24 bp, Artificial Sequence
  Description of Artificial Sequence: Synthetic oligonucleotide
acgtgggggagtaccgggtggtga

SEQ ID NO: 413521 - DNA, 23 bp, Artificial Sequence
  Description of Artificial Sequence: Synthetic oligonucleotide
cgtgggggagtaccgggtggtga

SEQ ID NO: 413522 - DNA, 23 bp, Artificial Sequence
  Description of Artificial Sequence: Synthetic oligonucleotide
gtgggggagtaccgggtggtgac

SEQ ID NO: 413523 - DNA, 23 bp, Artificial Sequence
  Description of Artificial Sequence: Synthetic oligonucleotide
tgggggagtaccgggtggtgacg

SEQ ID NO: 413524 - DNA, 22 bp, Artificial Sequence
  Description of Artificial Sequence: Synthetic oligonucleotide
gggggagtaccgggtggtgacg

SEQ ID NO: 413525 - DNA, 23 bp, Artificial Sequence
  Description of Artificial Sequence: Synthetic oligonucleotide
ggggagtaccgggtggtgacgga

SEQ ID NO: 413526 - DNA, 23 bp, Artificial Sequence
  Description of Artificial Sequence: Synthetic oligonucleotide
gggagtaccgggtggtgacggag

SEQ ID NO: 413527 - DNA, 24 bp, Artificial Sequence
  Description of Artificial Sequence: Synthetic oligonucleotide
ggagtaccgggtggtgacggagct

SEQ ID NO: 413528 - DNA, 24 bp, Artificial Sequence
  Description of Artificial Sequence: Synthetic oligonucleotide
gagtaccgggtggtgacggagctg

SEQ ID NO: 413529 - DNA, 24 bp, Artificial Sequence
  Description of Artificial Sequence: Synthetic oligonucleotide
agtaccgggtggtgacggagctgg

SEQ ID NO: 413530 - DNA, 23 bp, Artificial Sequence
  Description of Artificial Sequence: Synthetic oligonucleotide
gtaccgggtggtgacggagctgg

SEQ ID NO: 413531 - DNA, 23 bp, Artificial Sequence
  Description of Artificial Sequence: Synthetic oligonucleotide
taccgggtggtgacggagctggg

SEQ ID NO: 413532 - DNA, 22 bp, Artificial Sequence
  Description of Artificial Sequence: Synthetic oligonucleotide
accgggtggtgacggagctggg

SEQ ID NO: 413533 - DNA, 21 bp, Artificial Sequence
  Description of Artificial Sequence: Synthetic oligonucleotide
ccgggtggtgacggagctggg

SEQ ID NO: 413534 - DNA, 21 bp, Artificial Sequence
  Description of Artificial Sequence: Synthetic oligonucleotide
cgggtggtgacggagctgggg

SEQ ID NO: 413535 - DNA, 21 bp, Artificial Sequence
  Description of Artificial Sequence: Synthetic oligonucleotide
gggtggtgacggagctggggc

SEQ ID NO: 413536 - DNA, 21 bp, Artificial Sequence
  Description of Artificial Sequence: Synthetic oligonucleotide
ggtggtgacggagctggggcg

SEQ ID NO: 413537 - DNA, 21 bp, Artificial Sequence
  Description of Artificial Sequence: Synthetic oligonucleotide
gtggtgacggagctggggcgg

SEQ ID NO: 413538 - DNA, 21 bp, Artificial Sequence
  Description of Artificial Sequence: Synthetic oligonucleotide
tggtgacggagctggggcggc

SEQ ID NO: 413539 - DNA, 22 bp, Artificial Sequence
  Description of Artificial Sequence: Synthetic oligonucleotide
tcctggagcagaggcgggccct

SEQ ID NO: 413540 - DNA, 21 bp, Artificial Sequence
  Description of Artificial Sequence: Synthetic oligonucleotide
cctggagcagaggcgggccct

SEQ ID NO: 413541 - DNA, 21 bp, Artificial Sequence
  Description of Artificial Sequence: Synthetic oligonucleotide
ctggagcagaggcgggccctg

SEQ ID NO: 413542 - DNA, 22 bp, Artificial Sequence
  Description of Artificial Sequence: Synthetic oligonucleotide
tggagcagaggcgggccctggt

SEQ ID NO: 413543 - DNA, 21 bp, Artificial Sequence
  Description of Artificial Sequence: Synthetic oligonucleotide
ggagcagaggcgggccctggt

SEQ ID NO: 413544 - DNA, 21 bp, Artificial Sequence
  Description of Artificial Sequence: Synthetic oligonucleotide
gagcagaggcgggccctggtg

SEQ ID NO: 413545 - DNA, 22 bp, Artificial Sequence
  Description of Artificial Sequence: Synthetic oligonucleotide
agcagaggcgggccctggtgga

SEQ ID NO: 413546 - DNA, 21 bp, Artificial Sequence
  Description of Artificial Sequence: Synthetic oligonucleotide
gcagaggcgggccctggtgga

SEQ ID NO: 413547 - DNA, 22 bp, Artificial Sequence
  Description of Artificial Sequence: Synthetic oligonucleotide
cagaggcgggccctggtggaca

SEQ ID NO: 413548 - DNA, 22 bp, Artificial Sequence
  Description of Artificial Sequence: Synthetic oligonucleotide
agaggcgggccctggtggacac

SEQ ID NO: 413549 - DNA, 21 bp, Artificial Sequence
  Description of Artificial Sequence: Synthetic oligonucleotide
gaggcgggccctggtggacac

SEQ ID NO: 413550 - DNA, 26 bp, Artificial Sequence
  Description of Artificial Sequence: Synthetic oligonucleotide
cagaaggacctcctggagcagaggca

SEQ ID NO: 413551 - DNA, 26 bp, Artificial Sequence
  Description of Artificial Sequence: Synthetic oligonucleotide
agaaggacctcctggagcagaggcag

SEQ ID NO: 413552 - DNA, 25 bp, Artificial Sequence
  Description of Artificial Sequence: Synthetic oligonucleotide
gaaggacctcctggagcagaggcag

SEQ ID NO: 413553 - DNA, 25 bp, Artificial Sequence
  Description of Artificial Sequence: Synthetic oligonucleotide
aaggacctcctggagcagaggcagg

SEQ ID NO: 413554 - DNA, 24 bp, Artificial Sequence
  Description of Artificial Sequence: Synthetic oligonucleotide
aggacctcctggagcagaggcagg

SEQ ID NO: 413555 - DNA, 23 bp, Artificial Sequence
  Description of Artificial Sequence: Synthetic oligonucleotide
ggacctcctggagcagaggcagg

SEQ ID NO: 413556 - DNA, 23 bp, Artificial Sequence
  Description of Artificial Sequence: Synthetic oligonucleotide
gacctcctggagcagaggcaggc

SEQ ID NO: 413557 - DNA, 23 bp, Artificial Sequence
  Description of Artificial Sequence: Synthetic oligonucleotide
acctcctggagcagaggcaggcc

SEQ ID NO: 413558 - DNA, 22 bp, Artificial Sequence
  Description of Artificial Sequence: Synthetic oligonucleotide
cctcctggagcagaggcaggcc

SEQ ID NO: 413559 - DNA, 22 bp, Artificial Sequence
  Description of Artificial Sequence: Synthetic oligonucleotide
ctcctggagcagaggcaggccg

SEQ ID NO: 413560 - DNA, 22 bp, Artificial Sequence
  Description of Artificial Sequence: Synthetic oligonucleotide
tcctggagcagaggcaggccgc

SEQ ID NO: 413561 - DNA, 21 bp, Artificial Sequence
  Description of Artificial Sequence: Synthetic oligonucleotide
cctggagcagaggcaggccgc

SEQ ID NO: 413562 - DNA, 21 bp, Artificial Sequence
  Description of Artificial Sequence: Synthetic oligonucleotide
ctggagcagaggcaggccgcg

SEQ ID NO: 413563 - DNA, 22 bp, Artificial Sequence
  Description of Artificial Sequence: Synthetic oligonucleotide
tggagcagaggcaggccgcggt

SEQ ID NO: 413564 - DNA, 21 bp, Artificial Sequence
  Description of Artificial Sequence: Synthetic oligonucleotide
ggagcagaggcaggccgcggt

SEQ ID NO: 413565 - DNA, 21 bp, Artificial Sequence
  Description of Artificial Sequence: Synthetic oligonucleotide
gagcagaggcaggccgcggtg

SEQ ID NO: 413566 - DNA, 22 bp, Artificial Sequence
  Description of Artificial Sequence: Synthetic oligonucleotide
agcagaggcaggccgcggtgga

SEQ ID NO: 413567 - DNA, 21 bp, Artificial Sequence
  Description of Artificial Sequence: Synthetic oligonucleotide
gcagaggcaggccgcggtgga

SEQ ID NO: 413568 - DNA, 22 bp, Artificial Sequence
  Description of Artificial Sequence: Synthetic oligonucleotide
cagaggcaggccgcggtggaca

SEQ ID NO: 413569 - DNA, 22 bp, Artificial Sequence
  Description of Artificial Sequence: Synthetic oligonucleotide
agaggcaggccgcggtggacac

SEQ ID NO: 413570 - DNA, 21 bp, Artificial Sequence
  Description of Artificial Sequence: Synthetic oligonucleotide
gaggcaggccgcggtggacac

SEQ ID NO: 413571 - DNA, 23 bp, Artificial Sequence
  Description of Artificial Sequence: Synthetic oligonucleotide
aggcaggccgcggtggacaccta

SEQ ID NO: 413572 - DNA, 22 bp, Artificial Sequence
  Description of Artificial Sequence: Synthetic oligonucleotide
ggcaggccgcggtggacaccta

SEQ ID NO: 413573 - DNA, 23 bp, Artificial Sequence
  Description of Artificial Sequence: Synthetic oligonucleotide
gcaggccgcggtggacacctact

SEQ ID NO: 413574 - DNA, 23 bp, Artificial Sequence
  Description of Artificial Sequence: Synthetic oligonucleotide
caggccgcggtggacacctactg

SEQ ID NO: 413575 - DNA, 24 bp, Artificial Sequence
  Description of Artificial Sequence: Synthetic oligonucleotide
aggccgcggtggacacctactgca

SEQ ID NO: 413576 - DNA, 35 bp, Artificial Sequence; identical to SEQ ID NO: 67263
  Description of Artificial Sequence: Synthetic oligonucleotide

SEQ ID NO: 413577 - DNA, 34 bp, Artificial Sequence; identical to SEQ ID NO: 67264
  Description of Artificial Sequence: Synthetic oligonucleotide

SEQ ID NO: 413578 - DNA, 36 bp, Artificial Sequence; identical to SEQ ID NO: 67265
  Description of Artificial Sequence: Synthetic oligonucleotide

SEQ ID NO: 413579 - DNA, 35 bp, Artificial Sequence; identical to SEQ ID NO: 67266
  Description of Artificial Sequence: Synthetic oligonucleotide

SEQ ID NO: 413580 - DNA, 35 bp, Artificial Sequence; identical to SEQ ID NO: 67267
  Description of Artificial Sequence: Synthetic oligonucleotide

SEQ ID NO: 413581 - DNA, 34 bp, Artificial Sequence; identical to SEQ ID NO: 67268
  Description of Artificial Sequence: Synthetic oligonucleotide

SEQ ID NO: 413582 - DNA, 33 bp, Artificial Sequence; identical to SEQ ID NO: 67269
  Description of Artificial Sequence: Synthetic oligonucleotide

SEQ ID NO: 413583 - DNA, 32 bp, Artificial Sequence; identical to SEQ ID NO: 67270
  Description of Artificial Sequence: Synthetic oligonucleotide

SEQ ID NO: 413584 - DNA, 33 bp, Artificial Sequence; identical to SEQ ID NO: 67271
  Description of Artificial Sequence: Synthetic oligonucleotide

SEQ ID NO: 413585 - DNA, 32 bp, Artificial Sequence; identical to SEQ ID NO: 67272
  Description of Artificial Sequence: Synthetic oligonucleotide

SEQ ID NO: 413586 - DNA, 31 bp, Artificial Sequence; identical to SEQ ID NO: 67273
  Description of Artificial Sequence: Synthetic oligonucleotide

SEQ ID NO: 413587 - DNA, 32 bp, Artificial Sequence; identical to SEQ ID NO: 67274
  Description of Artificial Sequence: Synthetic oligonucleotide

SEQ ID NO: 413588 - DNA, 31 bp, Artificial Sequence; identical to SEQ ID NO: 67275
  Description of Artificial Sequence: Synthetic oligonucleotide

SEQ ID NO: 413589 - DNA, 30 bp, Artificial Sequence; identical to SEQ ID NO: 67276
  Description of Artificial Sequence: Synthetic oligonucleotide

SEQ ID NO: 413590 - DNA, 29 bp, Artificial Sequence
  Description of Artificial Sequence: Synthetic oligonucleotide
caccaagaggagtacgtgcacttcgacag

SEQ ID NO: 413591 - DNA, 29 bp, Artificial Sequence
  Description of Artificial Sequence: Synthetic oligonucleotide
accaagaggagtacgtgcacttcgacagc

SEQ ID NO: 413592 - DNA, 28 bp, Artificial Sequence
  Description of Artificial Sequence: Synthetic oligonucleotide
ccaagaggagtacgtgcacttcgacagc

SEQ ID NO: 413593 - DNA, 28 bp, Artificial Sequence
  Description of Artificial Sequence: Synthetic oligonucleotide
caagaggagtacgtgcacttcgacagcg

SEQ ID NO: 413594 - DNA, 29 bp, Artificial Sequence
  Description of Artificial Sequence: Synthetic oligonucleotide
aagaggagtacgtgcacttcgacagcgac

SEQ ID NO: 413595 - DNA, 25 bp, Artificial Sequence
  Description of Artificial Sequence: Synthetic oligonucleotide
tgcacttcgacagcgacgtggggga

SEQ ID NO: 413596 - DNA, 24 bp, Artificial Sequence
  Description of Artificial Sequence: Synthetic oligonucleotide
gcacttcgacagcgacgtggggga

SEQ ID NO: 413597 - DNA, 26 bp, Artificial Sequence
  Description of Artificial Sequence: Synthetic oligonucleotide
cacttcgacagcgacgtgggggagta

SEQ ID NO: 413598 - DNA, 26 bp, Artificial Sequence
  Description of Artificial Sequence: Synthetic oligonucleotide
acttcgacagcgacgtgggggagtac

SEQ ID NO: 413599 - DNA, 33 bp, Artificial Sequence; identical to SEQ ID NO: 67297
  Description of Artificial Sequence: Synthetic oligonucleotide

SEQ ID NO: 413600 - DNA, 37 bp, Artificial Sequence; identical to SEQ ID NO: 67298
  Description of Artificial Sequence: Synthetic oligonucleotide

SEQ ID NO: 413601 - DNA, 36 bp, Artificial Sequence; identical to SEQ ID NO: 67299
  Description of Artificial Sequence: Synthetic oligonucleotide

SEQ ID NO: 413602 - DNA, 38 bp, Artificial Sequence; identical to SEQ ID NO: 67300
  Description of Artificial Sequence: Synthetic oligonucleotide

SEQ ID NO: 413603 - DNA, 40 bp, Artificial Sequence; identical to SEQ ID NO: 67301
  Description of Artificial Sequence: Synthetic oligonucleotide

SEQ ID NO: 413604 - DNA, 39 bp, Artificial Sequence; identical to SEQ ID NO: 67302
  Description of Artificial Sequence: Synthetic oligonucleotide

SEQ ID NO: 413605 - DNA, 38 bp, Artificial Sequence; identical to SEQ ID NO: 67303
  Description of Artificial Sequence: Synthetic oligonucleotide

SEQ ID NO: 413606 - DNA, 37 bp, Artificial Sequence; identical to SEQ ID NO: 67304
  Description of Artificial Sequence: Synthetic oligonucleotide

SEQ ID NO: 413607 - DNA, 37 bp, Artificial Sequence; identical to SEQ ID NO: 67305
  Description of Artificial Sequence: Synthetic oligonucleotide

SEQ ID NO: 413608 - DNA, 36 bp, Artificial Sequence; identical to SEQ ID NO: 67306
  Description of Artificial Sequence: Synthetic oligonucleotide

SEQ ID NO: 413609 - DNA, 35 bp, Artificial Sequence; identical to SEQ ID NO: 67307
  Description of Artificial Sequence: Synthetic oligonucleotide

SEQ ID NO: 413610 - DNA, 35 bp, Artificial Sequence; identical to SEQ ID NO: 67308
  Description of Artificial Sequence: Synthetic oligonucleotide

SEQ ID NO: 413611 - DNA, 35 bp, Artificial Sequence; identical to SEQ ID NO: 67309
  Description of Artificial Sequence: Synthetic oligonucleotide

SEQ ID NO: 413612 - DNA, 34 bp, Artificial Sequence; identical to SEQ ID NO: 67310
  Description of Artificial Sequence: Synthetic oligonucleotide

SEQ ID NO: 413613 - DNA, 35 bp, Artificial Sequence; identical to SEQ ID NO: 67311
  Description of Artificial Sequence: Synthetic oligonucleotide

SEQ ID NO: 413614 - DNA, 35 bp, Artificial Sequence; identical to SEQ ID NO: 67312
  Description of Artificial Sequence: Synthetic oligonucleotide

SEQ ID NO: 413615 - DNA, 34 bp, Artificial Sequence; identical to SEQ ID NO: 67313
  Description of Artificial Sequence: Synthetic oligonucleotide

SEQ ID NO: 413616 - DNA, 34 bp, Artificial Sequence; identical to SEQ ID NO: 67314
  Description of Artificial Sequence: Synthetic oligonucleotide

SEQ ID NO: 413617 - DNA, 35 bp, Artificial Sequence; identical to SEQ ID NO: 67315
  Description of Artificial Sequence: Synthetic oligonucleotide

SEQ ID NO: 413618 - DNA, 34 bp, Artificial Sequence; identical to SEQ ID NO: 67316
  Description of Artificial Sequence: Synthetic oligonucleotide

SEQ ID NO: 413619 - DNA, 33 bp, Artificial Sequence; identical to SEQ ID NO: 67317
  Description of Artificial Sequence: Synthetic oligonucleotide

SEQ ID NO: 413620 - DNA, 32 bp, Artificial Sequence; identical to SEQ ID NO: 67318
  Description of Artificial Sequence: Synthetic oligonucleotide

SEQ ID NO: 413621 - DNA, 31 bp, Artificial Sequence; identical to SEQ ID NO: 67319
  Description of Artificial Sequence: Synthetic oligonucleotide

SEQ ID NO: 413622 - DNA, 30 bp, Artificial Sequence; identical to SEQ ID NO: 67320
  Description of Artificial Sequence: Synthetic oligonucleotide

SEQ ID NO: 413623 - DNA, 30 bp, Artificial Sequence; identical to SEQ ID NO: 67321
  Description of Artificial Sequence: Synthetic oligonucleotide

SEQ ID NO: 413624 - DNA, 28 bp, Artificial Sequence
  Description of Artificial Sequence: Synthetic oligonucleotide
aacagccagaaggacctcctggaagacg

SEQ ID NO: 413625 - DNA, 27 bp, Artificial Sequence
  Description of Artificial Sequence: Synthetic oligonucleotide
acagccagaaggacctcctggaagacg

SEQ ID NO: 413626 - DNA, 27 bp, Artificial Sequence
  Description of Artificial Sequence: Synthetic oligonucleotide
cagccagaaggacctcctggaagacga

SEQ ID NO: 413627 - DNA, 27 bp, Artificial Sequence
  Description of Artificial Sequence: Synthetic oligonucleotide
agccagaaggacctcctggaagacgag

SEQ ID NO: 413628 - DNA, 26 bp, Artificial Sequence
  Description of Artificial Sequence: Synthetic oligonucleotide
gccagaaggacctcctggaagacgag

SEQ ID NO: 413629 - DNA, 26 bp, Artificial Sequence
  Description of Artificial Sequence: Synthetic oligonucleotide
ccagaaggacctcctggaagacgagc

SEQ ID NO: 413630 - DNA, 26 bp, Artificial Sequence
  Description of Artificial Sequence: Synthetic oligonucleotide
cagaaggacctcctggaagacgagcg

SEQ ID NO: 413631 - DNA, 26 bp, Artificial Sequence
  Description of Artificial Sequence: Synthetic oligonucleotide
agaaggacctcctggaagacgagcgg

SEQ ID NO: 413632 - DNA, 25 bp, Artificial Sequence
  Description of Artificial Sequence: Synthetic oligonucleotide
gaaggacctcctggaagacgagcgg

SEQ ID NO: 413633 - DNA, 25 bp, Artificial Sequence
  Description of Artificial Sequence: Synthetic oligonucleotide
aaggacctcctggaagacgagcggg

SEQ ID NO: 413634 - DNA, 24 bp, Artificial Sequence
  Description of Artificial Sequence: Synthetic oligonucleotide
aggacctcctggaagacgagcggg

SEQ ID NO: 413635 - DNA, 23 bp, Artificial Sequence
  Description of Artificial Sequence: Synthetic oligonucleotide
ggacctcctggaagacgagcggg

SEQ ID NO: 413636 - DNA, 23 bp, Artificial Sequence
  Description of Artificial Sequence: Synthetic oligonucleotide
gacctcctggaagacgagcgggc

SEQ ID NO: 413637 - DNA, 23 bp, Artificial Sequence
  Description of Artificial Sequence: Synthetic oligonucleotide
acctcctggaagacgagcgggcc

SEQ ID NO: 413638 - DNA, 22 bp, Artificial Sequence
  Description of Artificial Sequence: Synthetic oligonucleotide
cctcctggaagacgagcgggcc

SEQ ID NO: 413639 - DNA, 22 bp, Artificial Sequence
  Description of Artificial Sequence: Synthetic oligonucleotide
ctcctggaagacgagcgggccg

SEQ ID NO: 413640 - DNA, 24 bp, Artificial Sequence
  Description of Artificial Sequence: Synthetic oligonucleotide
acatcctggagcagaagcgggccg

SEQ ID NO: 413641 - DNA, 23 bp, Artificial Sequence
  Description of Artificial Sequence: Synthetic oligonucleotide
catcctggagcagaagcgggccg

SEQ ID NO: 413642 - DNA, 23 bp, Artificial Sequence
  Description of Artificial Sequence: Synthetic oligonucleotide
atcctggagcagaagcgggccgc

SEQ ID NO: 413643 - DNA, 25 bp, Artificial Sequence
  Description of Artificial Sequence: Synthetic oligonucleotide
gcttcgacagcgacgtgggggacta

SEQ ID NO: 413644 - DNA, 25 bp, Artificial Sequence
  Description of Artificial Sequence: Synthetic oligonucleotide
cttcgacagcgacgtgggggactac

SEQ ID NO: 413645 - DNA, 25 bp, Artificial Sequence
  Description of Artificial Sequence: Synthetic oligonucleotide
ttcgacagcgacgtgggggactacc

SEQ ID NO: 413646 - DNA, 24 bp, Artificial Sequence
  Description of Artificial Sequence: Synthetic oligonucleotide
tcgacagcgacgtgggggactacc

SEQ ID NO: 413647 - DNA, 23 bp, Artificial Sequence
  Description of Artificial Sequence: Synthetic oligonucleotide
cgacagcgacgtgggggactacc

SEQ ID NO: 413648 - DNA, 23 bp, Artificial Sequence
  Description of Artificial Sequence: Synthetic oligonucleotide
gacagcgacgtgggggactaccg

SEQ ID NO: 413649 - DNA, 23 bp, Artificial Sequence
  Description of Artificial Sequence: Synthetic oligonucleotide
acagcgacgtgggggactaccgg

SEQ ID NO: 413650 - DNA, 22 bp, Artificial Sequence
  Description of Artificial Sequence: Synthetic oligonucleotide
cagcgacgtgggggactaccgg

SEQ ID NO: 413651 - DNA, 22 bp, Artificial Sequence
  Description of Artificial Sequence: Synthetic oligonucleotide
agcgacgtgggggactaccggg

SEQ ID NO: 413652 - DNA, 21 bp, Artificial Sequence
  Description of Artificial Sequence: Synthetic oligonucleotide
gcgacgtgggggactaccggg

SEQ ID NO: 413653 - DNA, 21 bp, Artificial Sequence
  Description of Artificial Sequence: Synthetic oligonucleotide
cgacgtgggggactaccgggc

SEQ ID NO: 413654 - DNA, 21 bp, Artificial Sequence
  Description of Artificial Sequence: Synthetic oligonucleotide
gacgtgggggactaccgggcg

SEQ ID NO: 413655 - DNA, 22 bp, Artificial Sequence
  Description of Artificial Sequence: Synthetic oligonucleotide
acgtgggggactaccgggcggt

SEQ ID NO: 413656 - DNA, 21 bp, Artificial Sequence
  Description of Artificial Sequence: Synthetic oligonucleotide
cgtgggggactaccgggcggt

SEQ ID NO: 413657 - DNA, 22 bp, Artificial Sequence
  Description of Artificial Sequence: Synthetic oligonucleotide
gtgggggactaccgggcggtga

SEQ ID NO: 413658 - DNA, 22 bp, Artificial Sequence
  Description of Artificial Sequence: Synthetic oligonucleotide
tgggggactaccgggcggtgac

SEQ ID NO: 413659 - DNA, 21 bp, Artificial Sequence
  Description of Artificial Sequence: Synthetic oligonucleotide
gggggactaccgggcggtgac

SEQ ID NO: 413660 - DNA, 21 bp, Artificial Sequence
  Description of Artificial Sequence: Synthetic oligonucleotide
ggggactaccgggcggtgacg

SEQ ID NO: 413661 - DNA, 22 bp, Artificial Sequence
  Description of Artificial Sequence: Synthetic oligonucleotide
gggactaccgggcggtgacgga

SEQ ID NO: 413662 - DNA, 22 bp, Artificial Sequence
  Description of Artificial Sequence: Synthetic oligonucleotide
ggactaccgggcggtgacggag

SEQ ID NO: 413663 - DNA, 23 bp, Artificial Sequence
  Description of Artificial Sequence: Synthetic oligonucleotide
gactaccgggcggtgacggagct

SEQ ID NO: 413664 - DNA, 23 bp, Artificial Sequence
  Description of Artificial Sequence: Synthetic oligonucleotide
actaccgggcggtgacggagctg

SEQ ID NO: 413665 - DNA, 22 bp, Artificial Sequence
  Description of Artificial Sequence: Synthetic oligonucleotide
ctaccgggcggtgacggagctg

SEQ ID NO: 413666 - DNA, 31 bp, Artificial Sequence; identical to SEQ ID NO: 67390
  Description of Artificial Sequence: Synthetic oligonucleotide

SEQ ID NO: 413667 - DNA, 30 bp, Artificial Sequence; identical to SEQ ID NO: 67391
  Description of Artificial Sequence: Synthetic oligonucleotide

SEQ ID NO: 413668 - DNA, 29 bp, Artificial Sequence
  Description of Artificial Sequence: Synthetic oligonucleotide
gagtgtcatttcttcaacgggacggagcc

SEQ ID NO: 413669 - DNA, 29 bp, Artificial Sequence
  Description of Artificial Sequence: Synthetic oligonucleotide
agtgtcatttcttcaacgggacggagccg

SEQ ID NO: 413670 - DNA, 28 bp, Artificial Sequence
  Description of Artificial Sequence: Synthetic oligonucleotide
gtgtcatttcttcaacgggacggagccg

SEQ ID NO: 413671 - DNA, 28 bp, Artificial Sequence
  Description of Artificial Sequence: Synthetic oligonucleotide
tgtcatttcttcaacgggacggagccgg

SEQ ID NO: 413672 - DNA, 27 bp, Artificial Sequence
  Description of Artificial Sequence: Synthetic oligonucleotide
gtcatttcttcaacgggacggagccgg

SEQ ID NO: 413673 - DNA, 28 bp, Artificial Sequence
  Description of Artificial Sequence: Synthetic oligonucleotide
tcatttcttcaacgggacggagccggtg

SEQ ID NO: 413674 - DNA, 27 bp, Artificial Sequence
  Description of Artificial Sequence: Synthetic oligonucleotide
catttcttcaacgggacggagccggtg

SEQ ID NO: 413675 - DNA, 27 bp, Artificial Sequence
  Description of Artificial Sequence: Synthetic oligonucleotide
atttcttcaacgggacggagccggtgc

SEQ ID NO: 413676 - DNA, 26 bp, Artificial Sequence
  Description of Artificial Sequence: Synthetic oligonucleotide
tttcttcaacgggacggagccggtgc

SEQ ID NO: 413677 - DNA, 25 bp, Artificial Sequence
  Description of Artificial Sequence: Synthetic oligonucleotide
ttcttcaacgggacggagccggtgc

SEQ ID NO: 413678 - DNA, 24 bp, Artificial Sequence
  Description of Artificial Sequence: Synthetic oligonucleotide
tcttcaacgggacggagccggtgc

SEQ ID NO: 413679 - DNA, 23 bp, Artificial Sequence
  Description of Artificial Sequence: Synthetic oligonucleotide
cttcaacgggacggagccggtgc

SEQ ID NO: 413680 - DNA, 23 bp, Artificial Sequence
  Description of Artificial Sequence: Synthetic oligonucleotide
ttcaacgggacggagccggtgcg

SEQ ID NO: 413681 - DNA, 22 bp, Artificial Sequence
  Description of Artificial Sequence: Synthetic oligonucleotide
tcaacgggacggagccggtgcg

SEQ ID NO: 413682 - DNA, 21 bp, Artificial Sequence
  Description of Artificial Sequence: Synthetic oligonucleotide
caacgggacggagccggtgcg

SEQ ID NO: 413683 - DNA, 23 bp, Artificial Sequence
  Description of Artificial Sequence: Synthetic oligonucleotide
aacgggacggagccggtgcggtt

SEQ ID NO: 413684 - DNA, 22 bp, Artificial Sequence
  Description of Artificial Sequence: Synthetic oligonucleotide
acgggacggagccggtgcggtt

SEQ ID NO: 413685 - DNA, 21 bp, Artificial Sequence
  Description of Artificial Sequence: Synthetic oligonucleotide
cgggacggagccggtgcggtt

SEQ ID NO: 413686 - DNA, 21 bp, Artificial Sequence
  Description of Artificial Sequence: Synthetic oligonucleotide
gggacggagccggtgcggttc

SEQ ID NO: 413687 - DNA, 22 bp, Artificial Sequence
  Description of Artificial Sequence: Synthetic oligonucleotide
ggacggagccggtgcggttcct

SEQ ID NO: 413688 - DNA, 22 bp, Artificial Sequence
  Description of Artificial Sequence: Synthetic oligonucleotide
gacggagccggtgcggttcctg

SEQ ID NO: 413689 - DNA, 23 bp, Artificial Sequence
  Description of Artificial Sequence: Synthetic oligonucleotide
acggagccggtgcggttcctgga

SEQ ID NO: 413690 - DNA, 22 bp, Artificial Sequence
  Description of Artificial Sequence: Synthetic oligonucleotide
cggagccggtgcggttcctgga

SEQ ID NO: 413691 - DNA, 23 bp, Artificial Sequence
  Description of Artificial Sequence: Synthetic oligonucleotide
ggagccggtgcggttcctggaca

SEQ ID NO: 413692 - DNA, 26 bp, Artificial Sequence
  Description of Artificial Sequence: Synthetic oligonucleotide
gagccggtgcggttcctggacagata

SEQ ID NO: 413693 - DNA, 27 bp, Artificial Sequence
  Description of Artificial Sequence: Synthetic oligonucleotide
agccggtgcggttcctggacagatact

SEQ ID NO: 413694 - DNA, 27 bp, Artificial Sequence
  Description of Artificial Sequence: Synthetic oligonucleotide
gccggtgcggttcctggacagatactt

SEQ ID NO: 413695 - DNA, 27 bp, Artificial Sequence
  Description of Artificial Sequence: Synthetic oligonucleotide
ccggtgcggttcctggacagatacttc

SEQ ID NO: 413696 - DNA, 30 bp, Artificial Sequence; identical to SEQ ID NO: 67420
  Description of Artificial Sequence: Synthetic oligonucleotide

SEQ ID NO: 413697 - DNA, 20 bp, Artificial Sequence
  Description of Artificial Sequence: Synthetic oligonucleotide
ggtgacggagctggggcggg

SEQ ID NO: 413698 - DNA, 21 bp, Artificial Sequence
  Description of Artificial Sequence: Synthetic oligonucleotide
gtgacggagctggggcgggct

SEQ ID NO: 413699 - DNA, 23 bp, Artificial Sequence
  Description of Artificial Sequence: Synthetic oligonucleotide
tgacggagctggggcgggctgat

SEQ ID NO: 413700 - DNA, 22 bp, Artificial Sequence
  Description of Artificial Sequence: Synthetic oligonucleotide
gacggagctggggcgggctgat

SEQ ID NO: 413701 - DNA, 22 bp, Artificial Sequence
  Description of Artificial Sequence: Synthetic oligonucleotide
acggagctggggcgggctgatg

SEQ ID NO: 413702 - DNA, 21 bp, Artificial Sequence
  Description of Artificial Sequence: Synthetic oligonucleotide
cggagctggggcgggctgatg

SEQ ID NO: 413703 - DNA, 21 bp, Artificial Sequence
  Description of Artificial Sequence: Synthetic oligonucleotide
ggagctggggcgggctgatgc

SEQ ID NO: 413704 - DNA, 21 bp, Artificial Sequence
  Description of Artificial Sequence: Synthetic oligonucleotide
gagctggggcgggctgatgcc

SEQ ID NO: 413705 - DNA, 22 bp, Artificial Sequence
  Description of Artificial Sequence: Synthetic oligonucleotide
agctggggcgggctgatgccga

SEQ ID NO: 413706 - DNA, 21 bp, Artificial Sequence
  Description of Artificial Sequence: Synthetic oligonucleotide
gctggggcgggctgatgccga

SEQ ID NO: 413707 - DNA, 23 bp, Artificial Sequence
  Description of Artificial Sequence: Synthetic oligonucleotide
ctggggcgggctgatgccgagta

SEQ ID NO: 413708 - DNA, 24 bp, Artificial Sequence
  Description of Artificial Sequence: Synthetic oligonucleotide
tggggcgggctgatgccgagtact

SEQ ID NO: 413709 - DNA, 23 bp, Artificial Sequence
  Description of Artificial Sequence: Synthetic oligonucleotide
ggggcgggctgatgccgagtact

SEQ ID NO: 413710 - DNA, 23 bp, Artificial Sequence
  Description of Artificial Sequence: Synthetic oligonucleotide
gggcgggctgatgccgagtactg

SEQ ID NO: 413711 - DNA, 25 bp, Artificial Sequence
  Description of Artificial Sequence: Synthetic oligonucleotide
ggcgggctgatgccgagtactggaa

SEQ ID NO: 413712 - DNA, 26 bp, Artificial Sequence
  Description of Artificial Sequence: Synthetic oligonucleotide
gcgggctgatgccgagtactggaaca

SEQ ID NO: 413713 - DNA, 26 bp, Artificial Sequence
  Description of Artificial Sequence: Synthetic oligonucleotide
cgggctgatgccgagtactggaacag

SEQ ID NO: 413714 - DNA, 26 bp, Artificial Sequence
  Description of Artificial Sequence: Synthetic oligonucleotide
gggctgatgccgagtactggaacagc

SEQ ID NO: 413715 - DNA, 27 bp, Artificial Sequence
  Description of Artificial Sequence: Synthetic oligonucleotide
ggctgatgccgagtactggaacagcca

SEQ ID NO: 413716 - DNA, 27 bp, Artificial Sequence
  Description of Artificial Sequence: Synthetic oligonucleotide
gctgatgccgagtactggaacagccag

SEQ ID NO: 413717 - DNA, 27 bp, Artificial Sequence
  Description of Artificial Sequence: Synthetic oligonucleotide
cagaaggacttcctggaagacaggcgc

SEQ ID NO: 413718 - DNA, 27 bp, Artificial Sequence
  Description of Artificial Sequence: Synthetic oligonucleotide
agaaggacttcctggaagacaggcgcg

SEQ ID NO: 413719 - DNA, 26 bp, Artificial Sequence
  Description of Artificial Sequence: Synthetic oligonucleotide
gaaggacttcctggaagacaggcgcg

SEQ ID NO: 413720 - DNA, 26 bp, Artificial Sequence
  Description of Artificial Sequence: Synthetic oligonucleotide
aaggacttcctggaagacaggcgcgc

SEQ ID NO: 413721 - DNA, 25 bp, Artificial Sequence
  Description of Artificial Sequence: Synthetic oligonucleotide
aggacttcctggaagacaggcgcgc

SEQ ID NO: 413722 - DNA, 24 bp, Artificial Sequence
  Description of Artificial Sequence: Synthetic oligonucleotide
ggacttcctggaagacaggcgcgc

SEQ ID NO: 413723 - DNA, 24 bp, Artificial Sequence
  Description of Artificial Sequence: Synthetic oligonucleotide
gacttcctggaagacaggcgcgcc

SEQ ID NO: 413724 - DNA, 24 bp, Artificial Sequence
  Description of Artificial Sequence: Synthetic oligonucleotide
acttcctggaagacaggcgcgccg

SEQ ID NO: 413725 - DNA, 23 bp, Artificial Sequence
  Description of Artificial Sequence: Synthetic oligonucleotide
cttcctggaagacaggcgcgccg

SEQ ID NO: 413726 - DNA, 23 bp, Artificial Sequence
  Description of Artificial Sequence: Synthetic oligonucleotide
ttcctggaagacaggcgcgccgc

SEQ ID NO: 413727 - DNA, 25 bp, Artificial Sequence
  Description of Artificial Sequence: Synthetic oligonucleotide
aaggacctcctggagcagaggcggt

SEQ ID NO: 413728 - DNA, 24 bp, Artificial Sequence
  Description of Artificial Sequence: Synthetic oligonucleotide
aggacctcctggagcagaggcggt

SEQ ID NO: 413729 - DNA, 23 bp, Artificial Sequence
  Description of Artificial Sequence: Synthetic oligonucleotide
ggacctcctggagcagaggcggt

SEQ ID NO: 413730 - DNA, 23 bp, Artificial Sequence
  Description of Artificial Sequence: Synthetic oligonucleotide
gacctcctggagcagaggcggtc

SEQ ID NO: 413731 - DNA, 23 bp, Artificial Sequence
  Description of Artificial Sequence: Synthetic oligonucleotide
acctcctggagcagaggcggtcc

SEQ ID NO: 413732 - DNA, 22 bp, Artificial Sequence
  Description of Artificial Sequence: Synthetic oligonucleotide
cctcctggagcagaggcggtcc

SEQ ID NO: 413733 - DNA, 22 bp, Artificial Sequence
  Description of Artificial Sequence: Synthetic oligonucleotide
ctcctggagcagaggcggtccg

SEQ ID NO: 413734 - DNA, 22 bp, Artificial Sequence
  Description of Artificial Sequence: Synthetic oligonucleotide
tcctggagcagaggcggtccgc

SEQ ID NO: 413735 - DNA, 21 bp, Artificial Sequence
  Description of Artificial Sequence: Synthetic oligonucleotide
cctggagcagaggcggtccgc

SEQ ID NO: 413736 - DNA, 21 bp, Artificial Sequence
  Description of Artificial Sequence: Synthetic oligonucleotide
ctggagcagaggcggtccgcg

SEQ ID NO: 413737 - DNA, 22 bp, Artificial Sequence
  Description of Artificial Sequence: Synthetic oligonucleotide
tggagcagaggcggtccgcggt

SEQ ID NO: 413738 - DNA, 21 bp, Artificial Sequence
  Description of Artificial Sequence: Synthetic oligonucleotide
ggagcagaggcggtccgcggt

SEQ ID NO: 413739 - DNA, 21 bp, Artificial Sequence
  Description of Artificial Sequence: Synthetic oligonucleotide
gagcagaggcggtccgcggtg

SEQ ID NO: 413740 - DNA, 22 bp, Artificial Sequence
  Description of Artificial Sequence: Synthetic oligonucleotide
agcagaggcggtccgcggtgga

SEQ ID NO: 413741 - DNA, 21 bp, Artificial Sequence
  Description of Artificial Sequence: Synthetic oligonucleotide
gcagaggcggtccgcggtgga

SEQ ID NO: 413742 - DNA, 22 bp, Artificial Sequence
  Description of Artificial Sequence: Synthetic oligonucleotide
cagaggcggtccgcggtggaca

SEQ ID NO: 413743 - DNA, 22 bp, Artificial Sequence
  Description of Artificial Sequence: Synthetic oligonucleotide
agaggcggtccgcggtggacac

SEQ ID NO: 413744 - DNA, 21 bp, Artificial Sequence
  Description of Artificial Sequence: Synthetic oligonucleotide
gaggcggtccgcggtggacac

SEQ ID NO: 413745 - DNA, 23 bp, Artificial Sequence
  Description of Artificial Sequence: Synthetic oligonucleotide
aggcggtccgcggtggacaccta

SEQ ID NO: 413746 - DNA, 22 bp, Artificial Sequence
  Description of Artificial Sequence: Synthetic oligonucleotide
ggcggtccgcggtggacaccta

SEQ ID NO: 413747 - DNA, 23 bp, Artificial Sequence
  Description of Artificial Sequence: Synthetic oligonucleotide
gcggtccgcggtggacacctact

SEQ ID NO: 413748 - DNA, 23 bp, Artificial Sequence
  Description of Artificial Sequence: Synthetic oligonucleotide
cggtccgcggtggacacctactg

SEQ ID NO: 413749 - DNA, 24 bp, Artificial Sequence
  Description of Artificial Sequence: Synthetic oligonucleotide
ggtccgcggtggacacctactgca

SEQ ID NO: 413750 - DNA, 25 bp, Artificial Sequence
  Description of Artificial Sequence: Synthetic oligonucleotide
gtccgcggtggacacctactgcaga

SEQ ID NO: 413751 - DNA, 26 bp, Artificial Sequence
  Description of Artificial Sequence: Synthetic oligonucleotide
tccgcggtggacacctactgcagaca

SEQ ID NO: 413752 - DNA, 41 bp, Artificial Sequence; identical to SEQ ID NO: 67476
  Description of Artificial Sequence: Synthetic oligonucleotide

SEQ ID NO: 413753 - DNA, 43 bp, Artificial Sequence; identical to SEQ ID NO: 67477
  Description of Artificial Sequence: Synthetic oligonucleotide

SEQ ID NO: 413754 - DNA, 42 bp, Artificial Sequence; identical to SEQ ID NO: 67478
  Description of Artificial Sequence: Synthetic oligonucleotide

SEQ ID NO: 413755 - DNA, 42 bp, Artificial Sequence; identical to SEQ ID NO: 67479
  Description of Artificial Sequence: Synthetic oligonucleotide

SEQ ID NO: 413756 - DNA, 42 bp, Artificial Sequence; identical to SEQ ID NO: 67480
  Description of Artificial Sequence: Synthetic oligonucleotide

SEQ ID NO: 413757 - DNA, 41 bp, Artificial Sequence; identical to SEQ ID NO: 67481
  Description of Artificial Sequence: Synthetic oligonucleotide

SEQ ID NO: 413758 - DNA, 40 bp, Artificial Sequence; identical to SEQ ID NO: 67482
  Description of Artificial Sequence: Synthetic oligonucleotide

SEQ ID NO: 413759 - DNA, 39 bp, Artificial Sequence; identical to SEQ ID NO: 67483
  Description of Artificial Sequence: Synthetic oligonucleotide

SEQ ID NO: 413760 - DNA, 39 bp, Artificial Sequence; identical to SEQ ID NO: 67484
  Description of Artificial Sequence: Synthetic oligonucleotide

SEQ ID NO: 413761 - DNA, 38 bp, Artificial Sequence; identical to SEQ ID NO: 67485
  Description of Artificial Sequence: Synthetic oligonucleotide

SEQ ID NO: 413762 - DNA, 37 bp, Artificial Sequence; identical to SEQ ID NO: 67486
  Description of Artificial Sequence: Synthetic oligonucleotide

SEQ ID NO: 413763 - DNA, 38 bp, Artificial Sequence; identical to SEQ ID NO: 67487
  Description of Artificial Sequence: Synthetic oligonucleotide

SEQ ID NO: 413764 - DNA, 38 bp, Artificial Sequence; identical to SEQ ID NO: 67488
  Description of Artificial Sequence: Synthetic oligonucleotide

SEQ ID NO: 413765 - DNA, 37 bp, Artificial Sequence; identical to SEQ ID NO: 67489
  Description of Artificial Sequence: Synthetic oligonucleotide

SEQ ID NO: 413766 - DNA, 37 bp, Artificial Sequence; identical to SEQ ID NO: 67490
  Description of Artificial Sequence: Synthetic oligonucleotide

SEQ ID NO: 413767 - DNA, 38 bp, Artificial Sequence; identical to SEQ ID NO: 67491
  Description of Artificial Sequence: Synthetic oligonucleotide

SEQ ID NO: 413768 - DNA, 37 bp, Artificial Sequence; identical to SEQ ID NO: 67492
  Description of Artificial Sequence: Synthetic oligonucleotide

SEQ ID NO: 413769 - DNA, 37 bp, Artificial Sequence; identical to SEQ ID NO: 67493
  Description of Artificial Sequence: Synthetic oligonucleotide

SEQ ID NO: 413770 - DNA, 21 bp, Artificial Sequence
  Description of Artificial Sequence: Synthetic oligonucleotide
aggcgggccgaggtggacacc

SEQ ID NO: 413771 - DNA, 20 bp, Artificial Sequence
  Description of Artificial Sequence: Synthetic oligonucleotide
ggcgggccgaggtggacacc

SEQ ID NO: 413772 - DNA, 21 bp, Artificial Sequence
  Description of Artificial Sequence: Synthetic oligonucleotide
gcgggccgaggtggacaccca

SEQ ID NO: 413773 - DNA, 22 bp, Artificial Sequence
  Description of Artificial Sequence: Synthetic oligonucleotide
cgggccgaggtggacacccact

SEQ ID NO: 413774 - DNA, 22 bp, Artificial Sequence
  Description of Artificial Sequence: Synthetic oligonucleotide
gggccgaggtggacacccactg

SEQ ID NO: 413775 - DNA, 23 bp, Artificial Sequence
  Description of Artificial Sequence: Synthetic oligonucleotide
ggccgaggtggacacccactgca

SEQ ID NO: 413776 - DNA, 24 bp, Artificial Sequence
  Description of Artificial Sequence: Synthetic oligonucleotide
gccgaggtggacacccactgcaga

SEQ ID NO: 413777 - DNA, 25 bp, Artificial Sequence
  Description of Artificial Sequence: Synthetic oligonucleotide
ccgaggtggacacccactgcagaca

SEQ ID NO: 413778 - DNA, 27 bp, Artificial Sequence
  Description of Artificial Sequence: Synthetic oligonucleotide
cgaggtggacacccactgcagacacaa

SEQ ID NO: 413779 - DNA, 27 bp, Artificial Sequence
  Description of Artificial Sequence: Synthetic oligonucleotide
gaggtggacacccactgcagacacaac

SEQ ID NO: 413780 - DNA, 29 bp, Artificial Sequence
  Description of Artificial Sequence: Synthetic oligonucleotide
aggtggacacccactgcagacacaactac

SEQ ID NO: 413781 - DNA, 28 bp, Artificial Sequence
  Description of Artificial Sequence: Synthetic oligonucleotide
ggtggacacccactgcagacacaactac

SEQ ID NO: 413782 - DNA, 28 bp, Artificial Sequence
  Description of Artificial Sequence: Synthetic oligonucleotide
gtggacacccactgcagacacaactacg

SEQ ID NO: 413783 - DNA, 28 bp, Artificial Sequence
  Description of Artificial Sequence: Synthetic oligonucleotide
tggacacccactgcagacacaactacgg

SEQ ID NO: 413784 - DNA, 27 bp, Artificial Sequence
  Description of Artificial Sequence: Synthetic oligonucleotide
ggacacccactgcagacacaactacgg

SEQ ID NO: 413785 - DNA, 27 bp, Artificial Sequence
  Description of Artificial Sequence: Synthetic oligonucleotide
gacacccactgcagacacaactacggg

SEQ ID NO: 413786 - DNA, 27 bp, Artificial Sequence
  Description of Artificial Sequence: Synthetic oligonucleotide
acacccactgcagacacaactacgggg

SEQ ID NO: 413787 - DNA, 27 bp, Artificial Sequence
  Description of Artificial Sequence: Synthetic oligonucleotide
cacccactgcagacacaactacggggt

SEQ ID NO: 413788 - DNA, 28 bp, Artificial Sequence
  Description of Artificial Sequence: Synthetic oligonucleotide
acccactgcagacacaactacggggttg

SEQ ID NO: 413789 - DNA, 27 bp, Artificial Sequence
  Description of Artificial Sequence: Synthetic oligonucleotide
cccactgcagacacaactacggggttg

SEQ ID NO: 413790 - DNA, 28 bp, Artificial Sequence
  Description of Artificial Sequence: Synthetic oligonucleotide
ccactgcagacacaactacggggttgtg

SEQ ID NO: 413791 - DNA, 28 bp, Artificial Sequence
  Description of Artificial Sequence: Synthetic oligonucleotide
cactgcagacacaactacggggttgtgg

SEQ ID NO: 413792 - DNA, 27 bp, Artificial Sequence
  Description of Artificial Sequence: Synthetic oligonucleotide
ggccgaggtggacacctactgcagata

SEQ ID NO: 413793 - DNA, 27 bp, Artificial Sequence
  Description of Artificial Sequence: Synthetic oligonucleotide
gccgaggtggacacctactgcagatac

SEQ ID NO: 413794 - DNA, 29 bp, Artificial Sequence
  Description of Artificial Sequence: Synthetic oligonucleotide
ccgaggtggacacctactgcagatacaac

SEQ ID NO: 413795 - DNA, 31 bp, Artificial Sequence; identical to SEQ ID NO: 67519
  Description of Artificial Sequence: Synthetic oligonucleotide

SEQ ID NO: 413796 - DNA, 31 bp, Artificial Sequence; identical to SEQ ID NO: 67520
  Description of Artificial Sequence: Synthetic oligonucleotide

SEQ ID NO: 413797 - DNA, 31 bp, Artificial Sequence; identical to SEQ ID NO: 67521
  Description of Artificial Sequence: Synthetic oligonucleotide

SEQ ID NO: 413798 - DNA, 30 bp, Artificial Sequence; identical to SEQ ID NO: 67522
  Description of Artificial Sequence: Synthetic oligonucleotide

SEQ ID NO: 413799 - DNA, 30 bp, Artificial Sequence; identical to SEQ ID NO: 67523
  Description of Artificial Sequence: Synthetic oligonucleotide

SEQ ID NO: 413800 - DNA, 30 bp, Artificial Sequence; identical to SEQ ID NO: 67524
  Description of Artificial Sequence: Synthetic oligonucleotide

SEQ ID NO: 413801 - DNA, 29 bp, Artificial Sequence
  Description of Artificial Sequence: Synthetic oligonucleotide
ggacacctactgcagatacaactacgggg

SEQ ID NO: 413802 - DNA, 31 bp, Artificial Sequence; identical to SEQ ID NO: 67526
  Description of Artificial Sequence: Synthetic oligonucleotide

SEQ ID NO: 413803 - DNA, 32 bp, Artificial Sequence; identical to SEQ ID NO: 67527
  Description of Artificial Sequence: Synthetic oligonucleotide

SEQ ID NO: 413804 - DNA, 31 bp, Artificial Sequence; identical to SEQ ID NO: 67528
  Description of Artificial Sequence: Synthetic oligonucleotide

SEQ ID NO: 413805 - DNA, 31 bp, Artificial Sequence; identical to SEQ ID NO: 67529
  Description of Artificial Sequence: Synthetic oligonucleotide

SEQ ID NO: 413806 - DNA, 30 bp, Artificial Sequence; identical to SEQ ID NO: 67530
  Description of Artificial Sequence: Synthetic oligonucleotide

SEQ ID NO: 413807 - DNA, 31 bp, Artificial Sequence; identical to SEQ ID NO: 67531
  Description of Artificial Sequence: Synthetic oligonucleotide

SEQ ID NO: 413808 - DNA, 32 bp, Artificial Sequence; identical to SEQ ID NO: 67532
  Description of Artificial Sequence: Synthetic oligonucleotide

SEQ ID NO: 413809 - DNA, 31 bp, Artificial Sequence; identical to SEQ ID NO: 67533
  Description of Artificial Sequence: Synthetic oligonucleotide

SEQ ID NO: 413810 - DNA, 30 bp, Artificial Sequence; identical to SEQ ID NO: 67534
  Description of Artificial Sequence: Synthetic oligonucleotide

SEQ ID NO: 413811 - DNA, 30 bp, Artificial Sequence; identical to SEQ ID NO: 67535
  Description of Artificial Sequence: Synthetic oligonucleotide

SEQ ID NO: 413812 - DNA, 29 bp, Artificial Sequence
  Description of Artificial Sequence: Synthetic oligonucleotide
gcagatacaactacggggttgtggagagc

SEQ ID NO: 413813 - DNA, 31 bp, Artificial Sequence; identical to SEQ ID NO: 67537
  Description of Artificial Sequence: Synthetic oligonucleotide

SEQ ID NO: 413814 - DNA, 32 bp, Artificial Sequence; identical to SEQ ID NO: 67538
  Description of Artificial Sequence: Synthetic oligonucleotide

SEQ ID NO: 413815 - DNA, 31 bp, Artificial Sequence; identical to SEQ ID NO: 67539
  Description of Artificial Sequence: Synthetic oligonucleotide

SEQ ID NO: 413816 - DNA, 32 bp, Artificial Sequence; identical to SEQ ID NO: 67540
  Description of Artificial Sequence: Synthetic oligonucleotide

SEQ ID NO: 413817 - DNA, 31 bp, Artificial Sequence; identical to SEQ ID NO: 67541
  Description of Artificial Sequence: Synthetic oligonucleotide

SEQ ID NO: 413818 - DNA, 27 bp, Artificial Sequence
  Description of Artificial Sequence: Synthetic oligonucleotide
cagaaggacatcctggaagacaggcgc

SEQ ID NO: 413819 - DNA, 27 bp, Artificial Sequence
  Description of Artificial Sequence: Synthetic oligonucleotide
agaaggacatcctggaagacaggcgcg

SEQ ID NO: 413820 - DNA, 26 bp, Artificial Sequence
  Description of Artificial Sequence: Synthetic oligonucleotide
gaaggacatcctggaagacaggcgcg

SEQ ID NO: 413821 - DNA, 26 bp, Artificial Sequence
  Description of Artificial Sequence: Synthetic oligonucleotide
aaggacatcctggaagacaggcgcgc

SEQ ID NO: 413822 - DNA, 25 bp, Artificial Sequence
  Description of Artificial Sequence: Synthetic oligonucleotide
aggacatcctggaagacaggcgcgc

SEQ ID NO: 413823 - DNA, 24 bp, Artificial Sequence
  Description of Artificial Sequence: Synthetic oligonucleotide
ggacatcctggaagacaggcgcgc

SEQ ID NO: 413824 - DNA, 24 bp, Artificial Sequence
  Description of Artificial Sequence: Synthetic oligonucleotide
gacatcctggaagacaggcgcgcc

SEQ ID NO: 413825 - DNA, 24 bp, Artificial Sequence
  Description of Artificial Sequence: Synthetic oligonucleotide
acatcctggaagacaggcgcgccg

SEQ ID NO: 413826 - DNA, 23 bp, Artificial Sequence
  Description of Artificial Sequence: Synthetic oligonucleotide
catcctggaagacaggcgcgccg

SEQ ID NO: 413827 - DNA, 23 bp, Artificial Sequence
  Description of Artificial Sequence: Synthetic oligonucleotide
atcctggaagacaggcgcgccgc

SEQ ID NO: 413828 - DNA, 22 bp, Artificial Sequence
  Description of Artificial Sequence: Synthetic oligonucleotide
tggggcggcctagcgccgagaa

SEQ ID NO: 413829 - DNA, 21 bp, Artificial Sequence
  Description of Artificial Sequence: Synthetic oligonucleotide
ggggcggcctagcgccgagaa

SEQ ID NO: 413830 - DNA, 22 bp, Artificial Sequence
  Description of Artificial Sequence: Synthetic oligonucleotide
gggcggcctagcgccgagaact

SEQ ID NO: 413831 - DNA, 22 bp, Artificial Sequence
  Description of Artificial Sequence: Synthetic oligonucleotide
ggcggcctagcgccgagaactg

SEQ ID NO: 413832 - DNA, 24 bp, Artificial Sequence
  Description of Artificial Sequence: Synthetic oligonucleotide
gcggcctagcgccgagaactggaa

SEQ ID NO: 413833 - DNA, 25 bp, Artificial Sequence
  Description of Artificial Sequence: Synthetic oligonucleotide
cggcctagcgccgagaactggaaca

SEQ ID NO: 413834 - DNA, 25 bp, Artificial Sequence
  Description of Artificial Sequence: Synthetic oligonucleotide
ggcctagcgccgagaactggaacag

SEQ ID NO: 413835 - DNA, 25 bp, Artificial Sequence
  Description of Artificial Sequence: Synthetic oligonucleotide
gcctagcgccgagaactggaacagc

SEQ ID NO: 413836 - DNA, 26 bp, Artificial Sequence
  Description of Artificial Sequence: Synthetic oligonucleotide
cctagcgccgagaactggaacagcca

SEQ ID NO: 413837 - DNA, 27 bp, Artificial Sequence
  Description of Artificial Sequence: Synthetic oligonucleotide
ctagcgccgagaactggaacagccaga

SEQ ID NO: 413838 - DNA, 28 bp, Artificial Sequence
  Description of Artificial Sequence: Synthetic oligonucleotide
tagcgccgagaactggaacagccagaag

SEQ ID NO: 413839 - DNA, 27 bp, Artificial Sequence
  Description of Artificial Sequence: Synthetic oligonucleotide
agcgccgagaactggaacagccagaag

SEQ ID NO: 413840 - DNA, 26 bp, Artificial Sequence
  Description of Artificial Sequence: Synthetic oligonucleotide
gcgccgagaactggaacagccagaag

SEQ ID NO: 413841 - DNA, 27 bp, Artificial Sequence
  Description of Artificial Sequence: Synthetic oligonucleotide
cgccgagaactggaacagccagaagga

SEQ ID NO: 413842 - DNA, 27 bp, Artificial Sequence
  Description of Artificial Sequence: Synthetic oligonucleotide
gccgagaactggaacagccagaaggac

SEQ ID NO: 413843 - DNA, 27 bp, Artificial Sequence
  Description of Artificial Sequence: Synthetic oligonucleotide
ccgagaactggaacagccagaaggacc

SEQ ID NO: 413844 - DNA, 28 bp, Artificial Sequence
  Description of Artificial Sequence: Synthetic oligonucleotide
cgagaactggaacagccagaaggacctc

SEQ ID NO: 413845 - DNA, 28 bp, Artificial Sequence
  Description of Artificial Sequence: Synthetic oligonucleotide
gagaactggaacagccagaaggacctcc

SEQ ID NO: 413846 - DNA, 29 bp, Artificial Sequence
  Description of Artificial Sequence: Synthetic oligonucleotide
agaactggaacagccagaaggacctcctg

SEQ ID NO: 413847 - DNA, 28 bp, Artificial Sequence
  Description of Artificial Sequence: Synthetic oligonucleotide
gaactggaacagccagaaggacctcctg

SEQ ID NO: 413848 - DNA, 28 bp, Artificial Sequence
  Description of Artificial Sequence: Synthetic oligonucleotide
aactggaacagccagaaggacctcctgg

SEQ ID NO: 413849 - DNA, 26 bp, Artificial Sequence
  Description of Artificial Sequence: Synthetic oligonucleotide
agaaggacctcctggaagacaggcgg

SEQ ID NO: 413850 - DNA, 25 bp, Artificial Sequence
  Description of Artificial Sequence: Synthetic oligonucleotide
gaaggacctcctggaagacaggcgg

SEQ ID NO: 413851 - DNA, 25 bp, Artificial Sequence
  Description of Artificial Sequence: Synthetic oligonucleotide
aaggacctcctggaagacaggcggg

SEQ ID NO: 413852 - DNA, 24 bp, Artificial Sequence
  Description of Artificial Sequence: Synthetic oligonucleotide
aggacctcctggaagacaggcggg

SEQ ID NO: 413853 - DNA, 23 bp, Artificial Sequence
  Description of Artificial Sequence: Synthetic oligonucleotide
ggacctcctggaagacaggcggg

SEQ ID NO: 413854 - DNA, 23 bp, Artificial Sequence
  Description of Artificial Sequence: Synthetic oligonucleotide
gacctcctggaagacaggcgggc

SEQ ID NO: 413855 - DNA, 23 bp, Artificial Sequence
  Description of Artificial Sequence: Synthetic oligonucleotide
acctcctggaagacaggcgggcc

SEQ ID NO: 413856 - DNA, 22 bp, Artificial Sequence
  Description of Artificial Sequence: Synthetic oligonucleotide
cctcctggaagacaggcgggcc

SEQ ID NO: 413857 - DNA, 23 bp, Artificial Sequence
  Description of Artificial Sequence: Synthetic oligonucleotide
ctcctggaagacaggcgggccct

SEQ ID NO: 413858 - DNA, 27 bp, Artificial Sequence
  Description of Artificial Sequence: Synthetic oligonucleotide
gcggcctgatgccgagtactggaacaa

SEQ ID NO: 413859 - DNA, 27 bp, Artificial Sequence
  Description of Artificial Sequence: Synthetic oligonucleotide
cggcctgatgccgagtactggaacaac

SEQ ID NO: 413860 - DNA, 27 bp, Artificial Sequence
  Description of Artificial Sequence: Synthetic oligonucleotide
ggcctgatgccgagtactggaacaacc

SEQ ID NO: 413861 - DNA, 28 bp, Artificial Sequence
  Description of Artificial Sequence: Synthetic oligonucleotide
gcctgatgccgagtactggaacaaccag

SEQ ID NO: 413862 - DNA, 30 bp, Artificial Sequence; identical to SEQ ID NO: 67586
  Description of Artificial Sequence: Synthetic oligonucleotide

SEQ ID NO: 413863 - DNA, 30 bp, Artificial Sequence; identical to SEQ ID NO: 67587
  Description of Artificial Sequence: Synthetic oligonucleotide

SEQ ID NO: 413864 - DNA, 31 bp, Artificial Sequence; identical to SEQ ID NO: 67588
  Description of Artificial Sequence: Synthetic oligonucleotide

SEQ ID NO: 413865 - DNA, 30 bp, Artificial Sequence; identical to SEQ ID NO: 67589
  Description of Artificial Sequence: Synthetic oligonucleotide

SEQ ID NO: 413866 - DNA, 30 bp, Artificial Sequence; identical to SEQ ID NO: 67590
  Description of Artificial Sequence: Synthetic oligonucleotide

SEQ ID NO: 413867 - DNA, 29 bp, Artificial Sequence
  Description of Artificial Sequence: Synthetic oligonucleotide
tgccgagtactggaacaaccagaaggacc

SEQ ID NO: 413868 - DNA, 28 bp, Artificial Sequence
  Description of Artificial Sequence: Synthetic oligonucleotide
gccgagtactggaacaaccagaaggacc

SEQ ID NO: 413869 - DNA, 29 bp, Artificial Sequence
  Description of Artificial Sequence: Synthetic oligonucleotide
ccgagtactggaacaaccagaaggacctc

SEQ ID NO: 413870 - DNA, 29 bp, Artificial Sequence
  Description of Artificial Sequence: Synthetic oligonucleotide
cgagtactggaacaaccagaaggacctcc

SEQ ID NO: 413871 - DNA, 30 bp, Artificial Sequence; identical to SEQ ID NO: 67595
  Description of Artificial Sequence: Synthetic oligonucleotide

SEQ ID NO: 413872 - DNA, 30 bp, Artificial Sequence; identical to SEQ ID NO: 67596
  Description of Artificial Sequence: Synthetic oligonucleotide

SEQ ID NO: 413873 - DNA, 29 bp, Artificial Sequence
  Description of Artificial Sequence: Synthetic oligonucleotide
gtactggaacaaccagaaggacctcctgg

SEQ ID NO: 413874 - DNA, 30 bp, Artificial Sequence; identical to SEQ ID NO: 67598
  Description of Artificial Sequence: Synthetic oligonucleotide

SEQ ID NO: 413875 - DNA, 29 bp, Artificial Sequence
  Description of Artificial Sequence: Synthetic oligonucleotide
actggaacaaccagaaggacctcctggag

SEQ ID NO: 413876 - DNA, 28 bp, Artificial Sequence
  Description of Artificial Sequence: Synthetic oligonucleotide
ctggaacaaccagaaggacctcctggag

SEQ ID NO: 413877 - DNA, 28 bp, Artificial Sequence
  Description of Artificial Sequence: Synthetic oligonucleotide
tggaacaaccagaaggacctcctggagc

SEQ ID NO: 413878 - DNA, 27 bp, Artificial Sequence
  Description of Artificial Sequence: Synthetic oligonucleotide
ggaacaaccagaaggacctcctggagc

SEQ ID NO: 413879 - DNA, 28 bp, Artificial Sequence
  Description of Artificial Sequence: Synthetic oligonucleotide
gaacaaccagaaggacctcctggagcag

SEQ ID NO: 413880 - DNA, 29 bp, Artificial Sequence
  Description of Artificial Sequence: Synthetic oligonucleotide
aacaaccagaaggacctcctggagcagag

SEQ ID NO: 413881 - DNA, 28 bp, Artificial Sequence
  Description of Artificial Sequence: Synthetic oligonucleotide
acaaccagaaggacctcctggagcagag

SEQ ID NO: 413882 - DNA, 27 bp, Artificial Sequence
  Description of Artificial Sequence: Synthetic oligonucleotide
caaccagaaggacctcctggagcagag

SEQ ID NO: 413883 - DNA, 27 bp, Artificial Sequence
  Description of Artificial Sequence: Synthetic oligonucleotide
aaccagaaggacctcctggagcagagg

SEQ ID NO: 413884 - DNA, 26 bp, Artificial Sequence
  Description of Artificial Sequence: Synthetic oligonucleotide
accagaaggacctcctggagcagagg

SEQ ID NO: 413885 - DNA, 41 bp, Artificial Sequence; identical to SEQ ID NO: 67609
  Description of Artificial Sequence: Synthetic oligonucleotide

SEQ ID NO: 413886 - DNA, 43 bp, Artificial Sequence; identical to SEQ ID NO: 67610
  Description of Artificial Sequence: Synthetic oligonucleotide

SEQ ID NO: 413887 - DNA, 42 bp, Artificial Sequence; identical to SEQ ID NO: 67611
  Description of Artificial Sequence: Synthetic oligonucleotide

SEQ ID NO: 413888 - DNA, 42 bp, Artificial Sequence; identical to SEQ ID NO: 67612
  Description of Artificial Sequence: Synthetic oligonucleotide

SEQ ID NO: 413889 - DNA, 42 bp, Artificial Sequence; identical to SEQ ID NO: 67613
  Description of Artificial Sequence: Synthetic oligonucleotide

SEQ ID NO: 413890 - DNA, 41 bp, Artificial Sequence; identical to SEQ ID NO: 67614
  Description of Artificial Sequence: Synthetic oligonucleotide

SEQ ID NO: 413891 - DNA, 40 bp, Artificial Sequence; identical to SEQ ID NO: 67615
  Description of Artificial Sequence: Synthetic oligonucleotide

SEQ ID NO: 413892 - DNA, 39 bp, Artificial Sequence; identical to SEQ ID NO: 67616
  Description of Artificial Sequence: Synthetic oligonucleotide

SEQ ID NO: 413893 - DNA, 39 bp, Artificial Sequence; identical to SEQ ID NO: 67617
  Description of Artificial Sequence: Synthetic oligonucleotide

SEQ ID NO: 413894 - DNA, 38 bp, Artificial Sequence; identical to SEQ ID NO: 67618
  Description of Artificial Sequence: Synthetic oligonucleotide

SEQ ID NO: 413895 - DNA, 37 bp, Artificial Sequence; identical to SEQ ID NO: 67619
  Description of Artificial Sequence: Synthetic oligonucleotide

SEQ ID NO: 413896 - DNA, 38 bp, Artificial Sequence; identical to SEQ ID NO: 67620
  Description of Artificial Sequence: Synthetic oligonucleotide

SEQ ID NO: 413897 - DNA, 38 bp, Artificial Sequence; identical to SEQ ID NO: 67621
  Description of Artificial Sequence: Synthetic oligonucleotide

SEQ ID NO: 413898 - DNA, 37 bp, Artificial Sequence; identical to SEQ ID NO: 67622
  Description of Artificial Sequence: Synthetic oligonucleotide

SEQ ID NO: 413899 - DNA, 37 bp, Artificial Sequence; identical to SEQ ID NO: 67623
  Description of Artificial Sequence: Synthetic oligonucleotide

SEQ ID NO: 413900 - DNA, 38 bp, Artificial Sequence; identical to SEQ ID NO: 67624
  Description of Artificial Sequence: Synthetic oligonucleotide

SEQ ID NO: 413901 - DNA, 37 bp, Artificial Sequence; identical to SEQ ID NO: 67625
  Description of Artificial Sequence: Synthetic oligonucleotide

SEQ ID NO: 413902 - DNA, 37 bp, Artificial Sequence; identical to SEQ ID NO: 67626
  Description of Artificial Sequence: Synthetic oligonucleotide

SEQ ID NO: 413903 - DNA, 37 bp, Artificial Sequence; identical to SEQ ID NO: 67627
  Description of Artificial Sequence: Synthetic oligonucleotide

SEQ ID NO: 413904 - DNA, 36 bp, Artificial Sequence; identical to SEQ ID NO: 67628
  Description of Artificial Sequence: Synthetic oligonucleotide

SEQ ID NO: 413905 - DNA, 35 bp, Artificial Sequence; identical to SEQ ID NO: 67629
  Description of Artificial Sequence: Synthetic oligonucleotide

SEQ ID NO: 413906 - DNA, 34 bp, Artificial Sequence; identical to SEQ ID NO: 67630
  Description of Artificial Sequence: Synthetic oligonucleotide

SEQ ID NO: 413907 - DNA, 33 bp, Artificial Sequence; identical to SEQ ID NO: 67631
  Description of Artificial Sequence: Synthetic oligonucleotide

SEQ ID NO: 413908 - DNA, 32 bp, Artificial Sequence; identical to SEQ ID NO: 67632
  Description of Artificial Sequence: Synthetic oligonucleotide

SEQ ID NO: 413909 - DNA, 27 bp, Artificial Sequence
  Description of Artificial Sequence: Synthetic oligonucleotide
acagccagaaggacctcctggagcagt

SEQ ID NO: 413910 - DNA, 26 bp, Artificial Sequence
  Description of Artificial Sequence: Synthetic oligonucleotide
cagccagaaggacctcctggagcagt

SEQ ID NO: 413911 - DNA, 26 bp, Artificial Sequence
  Description of Artificial Sequence: Synthetic oligonucleotide
agccagaaggacctcctggagcagtg

SEQ ID NO: 413912 - DNA, 25 bp, Artificial Sequence
  Description of Artificial Sequence: Synthetic oligonucleotide
gccagaaggacctcctggagcagtg

SEQ ID NO: 413913 - DNA, 25 bp, Artificial Sequence
  Description of Artificial Sequence: Synthetic oligonucleotide
ccagaaggacctcctggagcagtgg

SEQ ID NO: 413914 - DNA, 25 bp, Artificial Sequence
  Description of Artificial Sequence: Synthetic oligonucleotide
cagaaggacctcctggagcagtggc

SEQ ID NO: 413915 - DNA, 25 bp, Artificial Sequence
  Description of Artificial Sequence: Synthetic oligonucleotide
agaaggacctcctggagcagtggcg

SEQ ID NO: 413916 - DNA, 24 bp, Artificial Sequence
  Description of Artificial Sequence: Synthetic oligonucleotide
gaaggacctcctggagcagtggcg

SEQ ID NO: 413917 - DNA, 24 bp, Artificial Sequence
  Description of Artificial Sequence: Synthetic oligonucleotide
aaggacctcctggagcagtggcgg

SEQ ID NO: 413918 - DNA, 23 bp, Artificial Sequence
  Description of Artificial Sequence: Synthetic oligonucleotide
aggacctcctggagcagtggcgg

SEQ ID NO: 413919 - DNA, 22 bp, Artificial Sequence
  Description of Artificial Sequence: Synthetic oligonucleotide
ggacctcctggagcagtggcgg

SEQ ID NO: 413920 - DNA, 22 bp, Artificial Sequence
  Description of Artificial Sequence: Synthetic oligonucleotide
gacctcctggagcagtggcggg

SEQ ID NO: 413921 - DNA, 22 bp, Artificial Sequence
  Description of Artificial Sequence: Synthetic oligonucleotide
acctcctggagcagtggcgggc

SEQ ID NO: 413922 - DNA, 21 bp, Artificial Sequence
  Description of Artificial Sequence: Synthetic oligonucleotide
cctcctggagcagtggcgggc

SEQ ID NO: 413923 - DNA, 21 bp, Artificial Sequence
  Description of Artificial Sequence: Synthetic oligonucleotide
ctcctggagcagtggcgggcc

SEQ ID NO: 413924 - DNA, 22 bp, Artificial Sequence
  Description of Artificial Sequence: Synthetic oligonucleotide
tcctggagcagtggcgggccga

SEQ ID NO: 413925 - DNA, 21 bp, Artificial Sequence
  Description of Artificial Sequence: Synthetic oligonucleotide
cctggagcagtggcgggccga

SEQ ID NO: 413926 - DNA, 21 bp, Artificial Sequence
  Description of Artificial Sequence: Synthetic oligonucleotide
ctggagcagtggcgggccgag

SEQ ID NO: 413927 - DNA, 22 bp, Artificial Sequence
  Description of Artificial Sequence: Synthetic oligonucleotide
tggagcagtggcgggccgaggt

SEQ ID NO: 413928 - DNA, 21 bp, Artificial Sequence
  Description of Artificial Sequence: Synthetic oligonucleotide
ggagcagtggcgggccgaggt

SEQ ID NO: 413929 - DNA, 21 bp, Artificial Sequence
  Description of Artificial Sequence: Synthetic oligonucleotide
gagcagtggcgggccgaggtg

SEQ ID NO: 413930 - DNA, 22 bp, Artificial Sequence
  Description of Artificial Sequence: Synthetic oligonucleotide
agcagtggcgggccgaggtgga

SEQ ID NO: 413931 - DNA, 21 bp, Artificial Sequence
  Description of Artificial Sequence: Synthetic oligonucleotide
gcagtggcgggccgaggtgga

SEQ ID NO: 413932 - DNA, 22 bp, Artificial Sequence
  Description of Artificial Sequence: Synthetic oligonucleotide
cagtggcgggccgaggtggaca

SEQ ID NO: 413933 - DNA, 22 bp, Artificial Sequence
  Description of Artificial Sequence: Synthetic oligonucleotide
agtggcgggccgaggtggacac

SEQ ID NO: 413934 - DNA, 21 bp, Artificial Sequence
  Description of Artificial Sequence: Synthetic oligonucleotide
gtggcgggccgaggtggacac

SEQ ID NO: 413935 - DNA, 23 bp, Artificial Sequence
  Description of Artificial Sequence: Synthetic oligonucleotide
tggcgggccgaggtggacaccta

SEQ ID NO: 413936 - DNA, 31 bp, Artificial Sequence; identical to SEQ ID NO: 67660
  Description of Artificial Sequence: Synthetic oligonucleotide

SEQ ID NO: 413937 - DNA, 32 bp, Artificial Sequence; identical to SEQ ID NO: 67661
  Description of Artificial Sequence: Synthetic oligonucleotide

SEQ ID NO: 413938 - DNA, 31 bp, Artificial Sequence; identical to SEQ ID NO: 67662
  Description of Artificial Sequence: Synthetic oligonucleotide

SEQ ID NO: 413939 - DNA, 35 bp, Artificial Sequence; identical to SEQ ID NO: 67663
  Description of Artificial Sequence: Synthetic oligonucleotide

SEQ ID NO: 413940 - DNA, 37 bp, Artificial Sequence; identical to SEQ ID NO: 67664
  Description of Artificial Sequence: Synthetic oligonucleotide

SEQ ID NO: 413941 - DNA, 36 bp, Artificial Sequence; identical to SEQ ID NO: 67665
  Description of Artificial Sequence: Synthetic oligonucleotide

SEQ ID NO: 413942 - DNA, 35 bp, Artificial Sequence; identical to SEQ ID NO: 67666
  Description of Artificial Sequence: Synthetic oligonucleotide

SEQ ID NO: 413943 - DNA, 34 bp, Artificial Sequence; identical to SEQ ID NO: 67667
  Description of Artificial Sequence: Synthetic oligonucleotide

SEQ ID NO: 413944 - DNA, 36 bp, Artificial Sequence; identical to SEQ ID NO: 67668
  Description of Artificial Sequence: Synthetic oligonucleotide

SEQ ID NO: 413945 - DNA, 35 bp, Artificial Sequence; identical to SEQ ID NO: 67669
  Description of Artificial Sequence: Synthetic oligonucleotide

SEQ ID NO: 413946 - DNA, 34 bp, Artificial Sequence; identical to SEQ ID NO: 67670
  Description of Artificial Sequence: Synthetic oligonucleotide

SEQ ID NO: 413947 - DNA, 34 bp, Artificial Sequence; identical to SEQ ID NO: 67671
  Description of Artificial Sequence: Synthetic oligonucleotide

SEQ ID NO: 413948 - DNA, 34 bp, Artificial Sequence; identical to SEQ ID NO: 67672
  Description of Artificial Sequence: Synthetic oligonucleotide

SEQ ID NO: 413949 - DNA, 33 bp, Artificial Sequence; identical to SEQ ID NO: 67673
  Description of Artificial Sequence: Synthetic oligonucleotide

SEQ ID NO: 413950 - DNA, 33 bp, Artificial Sequence; identical to SEQ ID NO: 67674
  Description of Artificial Sequence: Synthetic oligonucleotide

SEQ ID NO: 413951 - DNA, 34 bp, Artificial Sequence; identical to SEQ ID NO: 67675
  Description of Artificial Sequence: Synthetic oligonucleotide

SEQ ID NO: 413952 - DNA, 33 bp, Artificial Sequence; identical to SEQ ID NO: 67676
  Description of Artificial Sequence: Synthetic oligonucleotide

SEQ ID NO: 413953 - DNA, 33 bp, Artificial Sequence; identical to SEQ ID NO: 67677
  Description of Artificial Sequence: Synthetic oligonucleotide

SEQ ID NO: 413954 - DNA, 33 bp, Artificial Sequence; identical to SEQ ID NO: 67678
  Description of Artificial Sequence: Synthetic oligonucleotide

SEQ ID NO: 413955 - DNA, 34 bp, Artificial Sequence; identical to SEQ ID NO: 67679
  Description of Artificial Sequence: Synthetic oligonucleotide

SEQ ID NO: 413956 - DNA, 33 bp, Artificial Sequence; identical to SEQ ID NO: 67680
  Description of Artificial Sequence: Synthetic oligonucleotide

SEQ ID NO: 413957 - DNA, 32 bp, Artificial Sequence; identical to SEQ ID NO: 67681
  Description of Artificial Sequence: Synthetic oligonucleotide

SEQ ID NO: 413958 - DNA, 31 bp, Artificial Sequence; identical to SEQ ID NO: 67682
  Description of Artificial Sequence: Synthetic oligonucleotide

SEQ ID NO: 413959 - DNA, 31 bp, Artificial Sequence; identical to SEQ ID NO: 67683
  Description of Artificial Sequence: Synthetic oligonucleotide

SEQ ID NO: 413960 - DNA, 26 bp, Artificial Sequence
  Description of Artificial Sequence: Synthetic oligonucleotide
gccgcggtggacacctactgcagata

SEQ ID NO: 413961 - DNA, 27 bp, Artificial Sequence
  Description of Artificial Sequence: Synthetic oligonucleotide
ccgcggtggacacctactgcagataca

SEQ ID NO: 413962 - DNA, 28 bp, Artificial Sequence
  Description of Artificial Sequence: Synthetic oligonucleotide
cgcggtggacacctactgcagatacaac

SEQ ID NO: 413963 - DNA, 30 bp, Artificial Sequence; identical to SEQ ID NO: 67695
  Description of Artificial Sequence: Synthetic oligonucleotide

SEQ ID NO: 413964 - DNA, 30 bp, Artificial Sequence; identical to SEQ ID NO: 67696
  Description of Artificial Sequence: Synthetic oligonucleotide

SEQ ID NO: 413965 - DNA, 41 bp, Artificial Sequence; identical to SEQ ID NO: 67697
  Description of Artificial Sequence: Synthetic oligonucleotide

SEQ ID NO: 413966 - DNA, 40 bp, Artificial Sequence; identical to SEQ ID NO: 67698
  Description of Artificial Sequence: Synthetic oligonucleotide

SEQ ID NO: 413967 - DNA, 39 bp, Artificial Sequence; identical to SEQ ID NO: 67699
  Description of Artificial Sequence: Synthetic oligonucleotide

SEQ ID NO: 413968 - DNA, 38 bp, Artificial Sequence; identical to SEQ ID NO: 67700
  Description of Artificial Sequence: Synthetic oligonucleotide

SEQ ID NO: 413969 - DNA, 38 bp, Artificial Sequence; identical to SEQ ID NO: 67701
  Description of Artificial Sequence: Synthetic oligonucleotide

SEQ ID NO: 413970 - DNA, 37 bp, Artificial Sequence; identical to SEQ ID NO: 67702
  Description of Artificial Sequence: Synthetic oligonucleotide

SEQ ID NO: 413971 - DNA, 36 bp, Artificial Sequence; identical to SEQ ID NO: 67703
  Description of Artificial Sequence: Synthetic oligonucleotide

SEQ ID NO: 413972 - DNA, 36 bp, Artificial Sequence; identical to SEQ ID NO: 67704
  Description of Artificial Sequence: Synthetic oligonucleotide

SEQ ID NO: 413973 - DNA, 37 bp, Artificial Sequence; identical to SEQ ID NO: 67705
  Description of Artificial Sequence: Synthetic oligonucleotide

SEQ ID NO: 413974 - DNA, 36 bp, Artificial Sequence; identical to SEQ ID NO: 67706
  Description of Artificial Sequence: Synthetic oligonucleotide

SEQ ID NO: 413975 - DNA, 36 bp, Artificial Sequence; identical to SEQ ID NO: 67707
  Description of Artificial Sequence: Synthetic oligonucleotide

SEQ ID NO: 413976 - DNA, 36 bp, Artificial Sequence; identical to SEQ ID NO: 67708
  Description of Artificial Sequence: Synthetic oligonucleotide

SEQ ID NO: 413977 - DNA, 35 bp, Artificial Sequence; identical to SEQ ID NO: 67709
  Description of Artificial Sequence: Synthetic oligonucleotide

SEQ ID NO: 413978 - DNA, 36 bp, Artificial Sequence; identical to SEQ ID NO: 67710
  Description of Artificial Sequence: Synthetic oligonucleotide

SEQ ID NO: 413979 - DNA, 36 bp, Artificial Sequence; identical to SEQ ID NO: 67711
  Description of Artificial Sequence: Synthetic oligonucleotide

SEQ ID NO: 413980 - DNA, 35 bp, Artificial Sequence; identical to SEQ ID NO: 67712
  Description of Artificial Sequence: Synthetic oligonucleotide

SEQ ID NO: 413981 - DNA, 34 bp, Artificial Sequence; identical to SEQ ID NO: 67713
  Description of Artificial Sequence: Synthetic oligonucleotide

SEQ ID NO: 413982 - DNA, 33 bp, Artificial Sequence; identical to SEQ ID NO: 67714
  Description of Artificial Sequence: Synthetic oligonucleotide

SEQ ID NO: 413983 - DNA, 32 bp, Artificial Sequence; identical to SEQ ID NO: 67715
  Description of Artificial Sequence: Synthetic oligonucleotide

SEQ ID NO: 413984 - DNA, 31 bp, Artificial Sequence; identical to SEQ ID NO: 67716
  Description of Artificial Sequence: Synthetic oligonucleotide

SEQ ID NO: 413985 - DNA, 31 bp, Artificial Sequence; identical to SEQ ID NO: 67717
  Description of Artificial Sequence: Synthetic oligonucleotide

SEQ ID NO: 413986 - DNA, 30 bp, Artificial Sequence; identical to SEQ ID NO: 67718
  Description of Artificial Sequence: Synthetic oligonucleotide

SEQ ID NO: 413987 - DNA, 29 bp, Artificial Sequence
  Description of Artificial Sequence: Synthetic oligonucleotide
gagtgtcatttcttcaaccggacggagcg

SEQ ID NO: 413988 - DNA, 29 bp, Artificial Sequence
  Description of Artificial Sequence: Synthetic oligonucleotide
agtgtcatttcttcaaccggacggagcgg

SEQ ID NO: 413989 - DNA, 28 bp, Artificial Sequence
  Description of Artificial Sequence: Synthetic oligonucleotide
gtgtcatttcttcaaccggacggagcgg

SEQ ID NO: 413990 - DNA, 28 bp, Artificial Sequence
  Description of Artificial Sequence: Synthetic oligonucleotide
tgtcatttcttcaaccggacggagcggg

SEQ ID NO: 413991 - DNA, 27 bp, Artificial Sequence
  Description of Artificial Sequence: Synthetic oligonucleotide
gtcatttcttcaaccggacggagcggg

SEQ ID NO: 413992 - DNA, 28 bp, Artificial Sequence
  Description of Artificial Sequence: Synthetic oligonucleotide
tcatttcttcaaccggacggagcgggtg

SEQ ID NO: 413993 - DNA, 27 bp, Artificial Sequence
  Description of Artificial Sequence: Synthetic oligonucleotide
catttcttcaaccggacggagcgggtg

SEQ ID NO: 413994 - DNA, 27 bp, Artificial Sequence
  Description of Artificial Sequence: Synthetic oligonucleotide
atttcttcaaccggacggagcgggtgc

SEQ ID NO: 413995 - DNA, 26 bp, Artificial Sequence
  Description of Artificial Sequence: Synthetic oligonucleotide
tttcttcaaccggacggagcgggtgc

SEQ ID NO: 413996 - DNA, 25 bp, Artificial Sequence
  Description of Artificial Sequence: Synthetic oligonucleotide
ttcttcaaccggacggagcgggtgc

SEQ ID NO: 413997 - DNA, 24 bp, Artificial Sequence
  Description of Artificial Sequence: Synthetic oligonucleotide
tcttcaaccggacggagcgggtgc

SEQ ID NO: 413998 - DNA, 23 bp, Artificial Sequence
  Description of Artificial Sequence: Synthetic oligonucleotide
cttcaaccggacggagcgggtgc

SEQ ID NO: 413999 - DNA, 23 bp, Artificial Sequence
  Description of Artificial Sequence: Synthetic oligonucleotide
ttcaaccggacggagcgggtgcg

SEQ ID NO: 414000 - DNA, 22 bp, Artificial Sequence
  Description of Artificial Sequence: Synthetic oligonucleotide
tcaaccggacggagcgggtgcg

SEQ ID NO: 414001 - DNA, 21 bp, Artificial Sequence
  Description of Artificial Sequence: Synthetic oligonucleotide
caaccggacggagcgggtgcg

SEQ ID NO: 414002 - DNA, 23 bp, Artificial Sequence
  Description of Artificial Sequence: Synthetic oligonucleotide
aaccggacggagcgggtgcggtt

SEQ ID NO: 414003 - DNA, 22 bp, Artificial Sequence
  Description of Artificial Sequence: Synthetic oligonucleotide
accggacggagcgggtgcggtt

SEQ ID NO: 414004 - DNA, 21 bp, Artificial Sequence
  Description of Artificial Sequence: Synthetic oligonucleotide
ccggacggagcgggtgcggtt

SEQ ID NO: 414005 - DNA, 21 bp, Artificial Sequence
  Description of Artificial Sequence: Synthetic oligonucleotide
cggacggagcgggtgcggttc

SEQ ID NO: 414006 - DNA, 23 bp, Artificial Sequence
  Description of Artificial Sequence: Synthetic oligonucleotide
cagaagcgggccgcggtggacaa

SEQ ID NO: 414007 - DNA, 25 bp, Artificial Sequence
  Description of Artificial Sequence: Synthetic oligonucleotide
agaagcgggccgcggtggacaacta

SEQ ID NO: 414008 - DNA, 24 bp, Artificial Sequence
  Description of Artificial Sequence: Synthetic oligonucleotide
gaagcgggccgcggtggacaacta

SEQ ID NO: 414009 - DNA, 25 bp, Artificial Sequence
  Description of Artificial Sequence: Synthetic oligonucleotide
aagcgggccgcggtggacaactact

SEQ ID NO: 414010 - DNA, 24 bp, Artificial Sequence
  Description of Artificial Sequence: Synthetic oligonucleotide
agcgggccgcggtggacaactact

SEQ ID NO: 414011 - DNA, 23 bp, Artificial Sequence
  Description of Artificial Sequence: Synthetic oligonucleotide
gcgggccgcggtggacaactact

SEQ ID NO: 414012 - DNA, 23 bp, Artificial Sequence
  Description of Artificial Sequence: Synthetic oligonucleotide
cgggccgcggtggacaactactg

SEQ ID NO: 414013 - DNA, 24 bp, Artificial Sequence
  Description of Artificial Sequence: Synthetic oligonucleotide
gggccgcggtggacaactactgca

SEQ ID NO: 414014 - DNA, 25 bp, Artificial Sequence
  Description of Artificial Sequence: Synthetic oligonucleotide
ggccgcggtggacaactactgcaga

SEQ ID NO: 414015 - DNA, 26 bp, Artificial Sequence
  Description of Artificial Sequence: Synthetic oligonucleotide
gccgcggtggacaactactgcagaca

SEQ ID NO: 414016 - DNA, 27 bp, Artificial Sequence
  Description of Artificial Sequence: Synthetic oligonucleotide
ccgcggtggacaactactgcagacaca

SEQ ID NO: 414017 - DNA, 28 bp, Artificial Sequence
  Description of Artificial Sequence: Synthetic oligonucleotide
cgcggtggacaactactgcagacacaac

SEQ ID NO: 414018 - DNA, 30 bp, Artificial Sequence; identical to SEQ ID NO: 67750
  Description of Artificial Sequence: Synthetic oligonucleotide

SEQ ID NO: 414019 - DNA, 30 bp, Artificial Sequence; identical to SEQ ID NO: 67751
  Description of Artificial Sequence: Synthetic oligonucleotide

SEQ ID NO: 414020 - DNA, 26 bp, Artificial Sequence
  Description of Artificial Sequence: Synthetic oligonucleotide
cagaagcgggccgcggtggacaatta

SEQ ID NO: 414021 - DNA, 27 bp, Artificial Sequence
  Description of Artificial Sequence: Synthetic oligonucleotide
agaagcgggccgcggtggacaattact

SEQ ID NO: 414022 - DNA, 26 bp, Artificial Sequence
  Description of Artificial Sequence: Synthetic oligonucleotide
gaagcgggccgcggtggacaattact

SEQ ID NO: 414023 - DNA, 26 bp, Artificial Sequence
  Description of Artificial Sequence: Synthetic oligonucleotide
aagcgggccgcggtggacaattactg

SEQ ID NO: 414024 - DNA, 25 bp, Artificial Sequence
  Description of Artificial Sequence: Synthetic oligonucleotide
agcgggccgcggtggacaattactg

SEQ ID NO: 414025 - DNA, 30 bp, Artificial Sequence; identical to SEQ ID NO: 67757
  Description of Artificial Sequence: Synthetic oligonucleotide

SEQ ID NO: 414026 - DNA, 30 bp, Artificial Sequence; identical to SEQ ID NO: 67758
  Description of Artificial Sequence: Synthetic oligonucleotide

SEQ ID NO: 414027 - DNA, 31 bp, Artificial Sequence; identical to SEQ ID NO: 67759
  Description of Artificial Sequence: Synthetic oligonucleotide

SEQ ID NO: 414028 - DNA, 26 bp, Artificial Sequence
  Description of Artificial Sequence: Synthetic oligonucleotide
cagaggcgggccgaggtggacaatta

SEQ ID NO: 414029 - DNA, 27 bp, Artificial Sequence
  Description of Artificial Sequence: Synthetic oligonucleotide
agaggcgggccgaggtggacaattact

SEQ ID NO: 414030 - DNA, 26 bp, Artificial Sequence
  Description of Artificial Sequence: Synthetic oligonucleotide
gaggcgggccgaggtggacaattact

SEQ ID NO: 414031 - DNA, 26 bp, Artificial Sequence
  Description of Artificial Sequence: Synthetic oligonucleotide
aggcgggccgaggtggacaattactg

SEQ ID NO: 414032 - DNA, 25 bp, Artificial Sequence
  Description of Artificial Sequence: Synthetic oligonucleotide
ggcgggccgaggtggacaattactg

SEQ ID NO: 414033 - DNA, 26 bp, Artificial Sequence
  Description of Artificial Sequence: Synthetic oligonucleotide
gcgggccgaggtggacaattactgca

SEQ ID NO: 414034 - DNA, 27 bp, Artificial Sequence
  Description of Artificial Sequence: Synthetic oligonucleotide
cgggccgaggtggacaattactgcaga

SEQ ID NO: 414035 - DNA, 27 bp, Artificial Sequence
  Description of Artificial Sequence: Synthetic oligonucleotide
gggccgaggtggacaattactgcagac

SEQ ID NO: 414036 - DNA, 28 bp, Artificial Sequence
  Description of Artificial Sequence: Synthetic oligonucleotide
ggccgaggtggacaattactgcagacac

SEQ ID NO: 414037 - DNA, 30 bp, Artificial Sequence; identical to SEQ ID NO: 67769
  Description of Artificial Sequence: Synthetic oligonucleotide

SEQ ID NO: 414038 - DNA, 32 bp, Artificial Sequence; identical to SEQ ID NO: 67770
  Description of Artificial Sequence: Synthetic oligonucleotide

SEQ ID NO: 414039 - DNA, 32 bp, Artificial Sequence; identical to SEQ ID NO: 67771
  Description of Artificial Sequence: Synthetic oligonucleotide

SEQ ID NO: 414040 - DNA, 32 bp, Artificial Sequence; identical to SEQ ID NO: 67772
  Description of Artificial Sequence: Synthetic oligonucleotide

SEQ ID NO: 414041 - DNA, 26 bp, Artificial Sequence
  Description of Artificial Sequence: Synthetic oligonucleotide
agccagaaggacctcctggagcagac

SEQ ID NO: 414042 - DNA, 25 bp, Artificial Sequence
  Description of Artificial Sequence: Synthetic oligonucleotide
gccagaaggacctcctggagcagac

SEQ ID NO: 414043 - DNA, 25 bp, Artificial Sequence
  Description of Artificial Sequence: Synthetic oligonucleotide
ccagaaggacctcctggagcagacg

SEQ ID NO: 414044 - DNA, 25 bp, Artificial Sequence
  Description of Artificial Sequence: Synthetic oligonucleotide
cagaaggacctcctggagcagacgc

SEQ ID NO: 414045 - DNA, 25 bp, Artificial Sequence
  Description of Artificial Sequence: Synthetic oligonucleotide
agaaggacctcctggagcagacgcg

SEQ ID NO: 414046 - DNA, 24 bp, Artificial Sequence
  Description of Artificial Sequence: Synthetic oligonucleotide
gaaggacctcctggagcagacgcg

SEQ ID NO: 414047 - DNA, 24 bp, Artificial Sequence
  Description of Artificial Sequence: Synthetic oligonucleotide
aaggacctcctggagcagacgcgg

SEQ ID NO: 414048 - DNA, 23 bp, Artificial Sequence
  Description of Artificial Sequence: Synthetic oligonucleotide
aggacctcctggagcagacgcgg

SEQ ID NO: 414049 - DNA, 22 bp, Artificial Sequence
  Description of Artificial Sequence: Synthetic oligonucleotide
ggacctcctggagcagacgcgg

SEQ ID NO: 414050 - DNA, 22 bp, Artificial Sequence
  Description of Artificial Sequence: Synthetic oligonucleotide
gacctcctggagcagacgcggg

SEQ ID NO: 414051 - DNA, 22 bp, Artificial Sequence
  Description of Artificial Sequence: Synthetic oligonucleotide
acctcctggagcagacgcgggc

SEQ ID NO: 414052 - DNA, 21 bp, Artificial Sequence
  Description of Artificial Sequence: Synthetic oligonucleotide
cctcctggagcagacgcgggc

SEQ ID NO: 414053 - DNA, 21 bp, Artificial Sequence
  Description of Artificial Sequence: Synthetic oligonucleotide
ctcctggagcagacgcgggcc

SEQ ID NO: 414054 - DNA, 21 bp, Artificial Sequence
  Description of Artificial Sequence: Synthetic oligonucleotide
tcctggagcagacgcgggccg

SEQ ID NO: 414055 - DNA, 20 bp, Artificial Sequence
  Description of Artificial Sequence: Synthetic oligonucleotide
cctggagcagacgcgggccg

SEQ ID NO: 414056 - DNA, 20 bp, Artificial Sequence
  Description of Artificial Sequence: Synthetic oligonucleotide
ctggagcagacgcgggccgc

SEQ ID NO: 414057 - DNA, 20 bp, Artificial Sequence
  Description of Artificial Sequence: Synthetic oligonucleotide
tggagcagacgcgggccgcg

SEQ ID NO: 414058 - DNA, 20 bp, Artificial Sequence
  Description of Artificial Sequence: Synthetic oligonucleotide
ggagcagacgcgggccgcgt

SEQ ID NO: 414059 - DNA, 20 bp, Artificial Sequence
  Description of Artificial Sequence: Synthetic oligonucleotide
gagcagacgcgggccgcggt

SEQ ID NO: 414060 - DNA, 20 bp, Artificial Sequence
  Description of Artificial Sequence: Synthetic oligonucleotide
agcagacgcgggccgcggtg

SEQ ID NO: 414061 - DNA, 20 bp, Artificial Sequence
  Description of Artificial Sequence: Synthetic oligonucleotide
gcagacgcgggccgcggtgt

SEQ ID NO: 414062 - DNA, 20 bp, Artificial Sequence
  Description of Artificial Sequence: Synthetic oligonucleotide
cagacgcgggccgcggtgga

SEQ ID NO: 414063 - DNA, 21 bp, Artificial Sequence
  Description of Artificial Sequence: Synthetic oligonucleotide
agacgcgggccgcggtggaca

SEQ ID NO: 414064 - DNA, 20 bp, Artificial Sequence
  Description of Artificial Sequence: Synthetic oligonucleotide
gacgcgggccgcggtggaca

SEQ ID NO: 414065 - DNA, 20 bp, Artificial Sequence
  Description of Artificial Sequence: Synthetic oligonucleotide
acgcgggccgcggtggacac

SEQ ID NO: 414066 - DNA, 24 bp, Artificial Sequence
  Description of Artificial Sequence: Synthetic oligonucleotide
ggagtaccgggcggtgacggagat

SEQ ID NO: 414067 - DNA, 24 bp, Artificial Sequence
  Description of Artificial Sequence: Synthetic oligonucleotide
gagtaccgggcggtgacggagatg

SEQ ID NO: 414068 - DNA, 24 bp, Artificial Sequence
  Description of Artificial Sequence: Synthetic oligonucleotide
agtaccgggcggtgacggagatgg

SEQ ID NO: 414069 - DNA, 23 bp, Artificial Sequence
  Description of Artificial Sequence: Synthetic oligonucleotide
gtaccgggcggtgacggagatgg

SEQ ID NO: 414070 - DNA, 23 bp, Artificial Sequence
  Description of Artificial Sequence: Synthetic oligonucleotide
taccgggcggtgacggagatggg

SEQ ID NO: 414071 - DNA, 22 bp, Artificial Sequence
  Description of Artificial Sequence: Synthetic oligonucleotide
accgggcggtgacggagatggg

SEQ ID NO: 414072 - DNA, 21 bp, Artificial Sequence
  Description of Artificial Sequence: Synthetic oligonucleotide
ccgggcggtgacggagatggg

SEQ ID NO: 414073 - DNA, 21 bp, Artificial Sequence
  Description of Artificial Sequence: Synthetic oligonucleotide
cgggcggtgacggagatgggg

SEQ ID NO: 414074 - DNA, 21 bp, Artificial Sequence
  Description of Artificial Sequence: Synthetic oligonucleotide
gggcggtgacggagatggggc

SEQ ID NO: 414075 - DNA, 21 bp, Artificial Sequence
  Description of Artificial Sequence: Synthetic oligonucleotide
ggcggtgacggagatggggcg

SEQ ID NO: 414076 - DNA, 21 bp, Artificial Sequence
  Description of Artificial Sequence: Synthetic oligonucleotide
gcggtgacggagatggggcgg

SEQ ID NO: 414077 - DNA, 21 bp, Artificial Sequence
  Description of Artificial Sequence: Synthetic oligonucleotide
cggtgacggagatggggcggc

SEQ ID NO: 414078 - DNA, 22 bp, Artificial Sequence
  Description of Artificial Sequence: Synthetic oligonucleotide
ggtgacggagatggggcggcct

SEQ ID NO: 414079 - DNA, 24 bp, Artificial Sequence
  Description of Artificial Sequence: Synthetic oligonucleotide
gtgacggagatggggcggcctgat

SEQ ID NO: 414080 - DNA, 24 bp, Artificial Sequence
  Description of Artificial Sequence: Synthetic oligonucleotide
tgacggagatggggcggcctgatg

SEQ ID NO: 414081 - DNA, 23 bp, Artificial Sequence
  Description of Artificial Sequence: Synthetic oligonucleotide
gacggagatggggcggcctgatg

SEQ ID NO: 414082 - DNA, 23 bp, Artificial Sequence
  Description of Artificial Sequence: Synthetic oligonucleotide
acggagatggggcggcctgatgc

SEQ ID NO: 414083 - DNA, 22 bp, Artificial Sequence
  Description of Artificial Sequence: Synthetic oligonucleotide
cggagatggggcggcctgatgc

SEQ ID NO: 414084 - DNA, 22 bp, Artificial Sequence
  Description of Artificial Sequence: Synthetic oligonucleotide
ggagatggggcggcctgatgcc

SEQ ID NO: 414085 - DNA, 23 bp, Artificial Sequence
  Description of Artificial Sequence: Synthetic oligonucleotide
gagatggggcggcctgatgccga

SEQ ID NO: 414086 - DNA, 25 bp, Artificial Sequence
  Description of Artificial Sequence: Synthetic oligonucleotide
agatggggcggcctgatgccgagta

SEQ ID NO: 414087 - DNA, 24 bp, Artificial Sequence
  Description of Artificial Sequence: Synthetic oligonucleotide
gatggggcggcctgatgccgagta

SEQ ID NO: 414088 - DNA, 25 bp, Artificial Sequence
  Description of Artificial Sequence: Synthetic oligonucleotide
atggggcggcctgatgccgagtact

SEQ ID NO: 414089 - DNA, 23 bp, Artificial Sequence
  Description of Artificial Sequence: Synthetic oligonucleotide
gcttcgacagcgacgtgggggag

SEQ ID NO: 414090 - DNA, 24 bp, Artificial Sequence
  Description of Artificial Sequence: Synthetic oligonucleotide
cttcgacagcgacgtgggggagca

SEQ ID NO: 414091 - DNA, 24 bp, Artificial Sequence
  Description of Artificial Sequence: Synthetic oligonucleotide
ttcgacagcgacgtgggggagcac

SEQ ID NO: 414092 - DNA, 23 bp, Artificial Sequence
  Description of Artificial Sequence: Synthetic oligonucleotide
tcgacagcgacgtgggggagcac

SEQ ID NO: 414093 - DNA, 22 bp, Artificial Sequence
  Description of Artificial Sequence: Synthetic oligonucleotide
cgacagcgacgtgggggagcac

SEQ ID NO: 414094 - DNA, 22 bp, Artificial Sequence
  Description of Artificial Sequence: Synthetic oligonucleotide
gacagcgacgtgggggagcacc

SEQ ID NO: 414095 - DNA, 22 bp, Artificial Sequence
  Description of Artificial Sequence: Synthetic oligonucleotide
acagcgacgtgggggagcaccg

SEQ ID NO: 414096 - DNA, 21 bp, Artificial Sequence
  Description of Artificial Sequence: Synthetic oligonucleotide
cagcgacgtgggggagcaccg

SEQ ID NO: 414097 - DNA, 21 bp, Artificial Sequence
  Description of Artificial Sequence: Synthetic oligonucleotide
agcgacgtgggggagcaccgg

SEQ ID NO: 414098 - DNA, 20 bp, Artificial Sequence
  Description of Artificial Sequence: Synthetic oligonucleotide
gcgacgtgggggagcaccgg

SEQ ID NO: 414099 - DNA, 20 bp, Artificial Sequence
  Description of Artificial Sequence: Synthetic oligonucleotide
cgacgtgggggagcaccggg

SEQ ID NO: 414100 - DNA, 20 bp, Artificial Sequence
  Description of Artificial Sequence: Synthetic oligonucleotide
gacgtgggggagcaccgggc

SEQ ID NO: 414101 - DNA, 20 bp, Artificial Sequence
  Description of Artificial Sequence: Synthetic oligonucleotide
acgtgggggagcaccgggcg

SEQ ID NO: 414102 - DNA, 20 bp, Artificial Sequence
  Description of Artificial Sequence: Synthetic oligonucleotide
cgtgggggagcaccgggcgt

SEQ ID NO: 414103 - DNA, 20 bp, Artificial Sequence
  Description of Artificial Sequence: Synthetic oligonucleotide
gtgggggagcaccgggcggt

SEQ ID NO: 414104 - DNA, 21 bp, Artificial Sequence
  Description of Artificial Sequence: Synthetic oligonucleotide
tgggggagcaccgggcggtga

SEQ ID NO: 414105 - DNA, 20 bp, Artificial Sequence
  Description of Artificial Sequence: Synthetic oligonucleotide
gggggagcaccgggcggtga

SEQ ID NO: 414106 - DNA, 20 bp, Artificial Sequence
  Description of Artificial Sequence: Synthetic oligonucleotide
ggggagcaccgggcggtgac

SEQ ID NO: 414107 - DNA, 20 bp, Artificial Sequence
  Description of Artificial Sequence: Synthetic oligonucleotide
gggagcaccgggcggtgacg

SEQ ID NO: 414108 - DNA, 21 bp, Artificial Sequence
  Description of Artificial Sequence: Synthetic oligonucleotide
ggagcaccgggcggtgacgga

SEQ ID NO: 414109 - DNA, 21 bp, Artificial Sequence
  Description of Artificial Sequence: Synthetic oligonucleotide
gagcaccgggcggtgacggag

SEQ ID NO: 414110 - DNA, 22 bp, Artificial Sequence
  Description of Artificial Sequence: Synthetic oligonucleotide
agcaccgggcggtgacggagct

SEQ ID NO: 414111 - DNA, 21 bp, Artificial Sequence
  Description of Artificial Sequence: Synthetic oligonucleotide
gcaccgggcggtgacggagct

SEQ ID NO: 414112 - DNA, 21 bp, Artificial Sequence
  Description of Artificial Sequence: Synthetic oligonucleotide
caccgggcggtgacggagctg

SEQ ID NO: 414113 - DNA, 29 bp, Artificial Sequence
  Description of Artificial Sequence: Synthetic oligonucleotide
aacagccagaaggacttcctggagcagag

SEQ ID NO: 414114 - DNA, 28 bp, Artificial Sequence
  Description of Artificial Sequence: Synthetic oligonucleotide
acagccagaaggacttcctggagcagag

SEQ ID NO: 414115 - DNA, 27 bp, Artificial Sequence
  Description of Artificial Sequence: Synthetic oligonucleotide
cagccagaaggacttcctggagcagag

SEQ ID NO: 414116 - DNA, 27 bp, Artificial Sequence
  Description of Artificial Sequence: Synthetic oligonucleotide
agccagaaggacttcctggagcagagg

SEQ ID NO: 414117 - DNA, 26 bp, Artificial Sequence
  Description of Artificial Sequence: Synthetic oligonucleotide
gccagaaggacttcctggagcagagg

SEQ ID NO: 414118 - DNA, 26 bp, Artificial Sequence
  Description of Artificial Sequence: Synthetic oligonucleotide
ccagaaggacttcctggagcagaggc

SEQ ID NO: 414119 - DNA, 26 bp, Artificial Sequence
  Description of Artificial Sequence: Synthetic oligonucleotide
cagaaggacttcctggagcagaggcg

SEQ ID NO: 414120 - DNA, 26 bp, Artificial Sequence
  Description of Artificial Sequence: Synthetic oligonucleotide
agaaggacttcctggagcagaggcgg

SEQ ID NO: 414121 - DNA, 25 bp, Artificial Sequence
  Description of Artificial Sequence: Synthetic oligonucleotide
gaaggacttcctggagcagaggcgg

SEQ ID NO: 414122 - DNA, 25 bp, Artificial Sequence
  Description of Artificial Sequence: Synthetic oligonucleotide
aaggacttcctggagcagaggcggg

SEQ ID NO: 414123 - DNA, 24 bp, Artificial Sequence
  Description of Artificial Sequence: Synthetic oligonucleotide
aggacttcctggagcagaggcggg

SEQ ID NO: 414124 - DNA, 23 bp, Artificial Sequence
  Description of Artificial Sequence: Synthetic oligonucleotide
ggacttcctggagcagaggcggg

SEQ ID NO: 414125 - DNA, 23 bp, Artificial Sequence
  Description of Artificial Sequence: Synthetic oligonucleotide
gacttcctggagcagaggcgggc

SEQ ID NO: 414126 - DNA, 23 bp, Artificial Sequence
  Description of Artificial Sequence: Synthetic oligonucleotide
acttcctggagcagaggcgggcc

SEQ ID NO: 414127 - DNA, 22 bp, Artificial Sequence
  Description of Artificial Sequence: Synthetic oligonucleotide
cttcctggagcagaggcgggcc

SEQ ID NO: 414128 - DNA, 22 bp, Artificial Sequence
  Description of Artificial Sequence: Synthetic oligonucleotide
ttcctggagcagaggcgggccg

SEQ ID NO: 414129 - DNA, 27 bp, Artificial Sequence
  Description of Artificial Sequence: Synthetic oligonucleotide
ccgagtcctggaacagccagaaggaca

SEQ ID NO: 414130 - DNA, 28 bp, Artificial Sequence
  Description of Artificial Sequence: Synthetic oligonucleotide
cgagtcctggaacagccagaaggacatc

SEQ ID NO: 414131 - DNA, 28 bp, Artificial Sequence
  Description of Artificial Sequence: Synthetic oligonucleotide
gagtcctggaacagccagaaggacatcc

SEQ ID NO: 414132 - DNA, 29 bp, Artificial Sequence
  Description of Artificial Sequence: Synthetic oligonucleotide
agtcctggaacagccagaaggacatcctg

SEQ ID NO: 414133 - DNA, 28 bp, Artificial Sequence
  Description of Artificial Sequence: Synthetic oligonucleotide
gtcctggaacagccagaaggacatcctg

SEQ ID NO: 414134 - DNA, 28 bp, Artificial Sequence
  Description of Artificial Sequence: Synthetic oligonucleotide
tcctggaacagccagaaggacatcctgg

SEQ ID NO: 414135 - DNA, 27 bp, Artificial Sequence
  Description of Artificial Sequence: Synthetic oligonucleotide
cctggaacagccagaaggacatcctgg

SEQ ID NO: 414136 - DNA, 31 bp, Artificial Sequence; identical to SEQ ID NO: 67888
  Description of Artificial Sequence: Synthetic oligonucleotide

SEQ ID NO: 414137 - DNA, 31 bp, Artificial Sequence; identical to SEQ ID NO: 67889
  Description of Artificial Sequence: Synthetic oligonucleotide

SEQ ID NO: 414138 - DNA, 33 bp, Artificial Sequence; identical to SEQ ID NO: 67890
  Description of Artificial Sequence: Synthetic oligonucleotide

SEQ ID NO: 414139 - DNA, 32 bp, Artificial Sequence; identical to SEQ ID NO: 67891
  Description of Artificial Sequence: Synthetic oligonucleotide

SEQ ID NO: 414140 - DNA, 33 bp, Artificial Sequence; identical to SEQ ID NO: 67892
  Description of Artificial Sequence: Synthetic oligonucleotide

SEQ ID NO: 414141 - DNA, 33 bp, Artificial Sequence; identical to SEQ ID NO: 67893
  Description of Artificial Sequence: Synthetic oligonucleotide

SEQ ID NO: 414142 - DNA, 34 bp, Artificial Sequence; identical to SEQ ID NO: 67894
  Description of Artificial Sequence: Synthetic oligonucleotide

SEQ ID NO: 414143 - DNA, 36 bp, Artificial Sequence; identical to SEQ ID NO: 67895
  Description of Artificial Sequence: Synthetic oligonucleotide

SEQ ID NO: 414144 - DNA, 35 bp, Artificial Sequence; identical to SEQ ID NO: 67896
  Description of Artificial Sequence: Synthetic oligonucleotide

SEQ ID NO: 414145 - DNA, 34 bp, Artificial Sequence; identical to SEQ ID NO: 67897
  Description of Artificial Sequence: Synthetic oligonucleotide

SEQ ID NO: 414146 - DNA, 34 bp, Artificial Sequence; identical to SEQ ID NO: 67898
  Description of Artificial Sequence: Synthetic oligonucleotide

SEQ ID NO: 414147 - DNA, 35 bp, Artificial Sequence; identical to SEQ ID NO: 67899
  Description of Artificial Sequence: Synthetic oligonucleotide

SEQ ID NO: 414148 - DNA, 34 bp, Artificial Sequence; identical to SEQ ID NO: 67900
  Description of Artificial Sequence: Synthetic oligonucleotide

SEQ ID NO: 414149 - DNA, 34 bp, Artificial Sequence; identical to SEQ ID NO: 67901
  Description of Artificial Sequence: Synthetic oligonucleotide

SEQ ID NO: 414150 - DNA, 34 bp, Artificial Sequence; identical to SEQ ID NO: 67902
  Description of Artificial Sequence: Synthetic oligonucleotide

SEQ ID NO: 414151 - DNA, 33 bp, Artificial Sequence; identical to SEQ ID NO: 67903
  Description of Artificial Sequence: Synthetic oligonucleotide

SEQ ID NO: 414152 - DNA, 33 bp, Artificial Sequence; identical to SEQ ID NO: 67904
  Description of Artificial Sequence: Synthetic oligonucleotide

SEQ ID NO: 414153 - DNA, 32 bp, Artificial Sequence; identical to SEQ ID NO: 67905
  Description of Artificial Sequence: Synthetic oligonucleotide

SEQ ID NO: 414154 - DNA, 34 bp, Artificial Sequence; identical to SEQ ID NO: 67906
  Description of Artificial Sequence: Synthetic oligonucleotide

SEQ ID NO: 414155 - DNA, 33 bp, Artificial Sequence; identical to SEQ ID NO: 67907
  Description of Artificial Sequence: Synthetic oligonucleotide

SEQ ID NO: 414156 - DNA, 32 bp, Artificial Sequence; identical to SEQ ID NO: 67908
  Description of Artificial Sequence: Synthetic oligonucleotide

SEQ ID NO: 414157 - DNA, 31 bp, Artificial Sequence; identical to SEQ ID NO: 67909
  Description of Artificial Sequence: Synthetic oligonucleotide

SEQ ID NO: 414158 - DNA, 31 bp, Artificial Sequence; identical to SEQ ID NO: 67910
  Description of Artificial Sequence: Synthetic oligonucleotide

SEQ ID NO: 414159 - DNA, 30 bp, Artificial Sequence; identical to SEQ ID NO: 67911
  Description of Artificial Sequence: Synthetic oligonucleotide

SEQ ID NO: 414160 - DNA, 29 bp, Artificial Sequence
  Description of Artificial Sequence: Synthetic oligonucleotide
ctatctccaagaggagtacgtgcgcttcg

SEQ ID NO: 414161 - DNA, 30 bp, Artificial Sequence; identical to SEQ ID NO: 67913
  Description of Artificial Sequence: Synthetic oligonucleotide

SEQ ID NO: 414162 - DNA, 29 bp, Artificial Sequence
  Description of Artificial Sequence: Synthetic oligonucleotide
atctccaagaggagtacgtgcgcttcgac

SEQ ID NO: 414163 - DNA, 28 bp, Artificial Sequence
  Description of Artificial Sequence: Synthetic oligonucleotide
tctccaagaggagtacgtgcgcttcgac

SEQ ID NO: 414164 - DNA, 27 bp, Artificial Sequence
  Description of Artificial Sequence: Synthetic oligonucleotide
ctccaagaggagtacgtgcgcttcgac

SEQ ID NO: 414165 - DNA, 28 bp, Artificial Sequence
  Description of Artificial Sequence: Synthetic oligonucleotide
tccaagaggagtacgtgcgcttcgacag

SEQ ID NO: 414166 - DNA, 41 bp, Artificial Sequence; identical to SEQ ID NO: 67918
  Description of Artificial Sequence: Synthetic oligonucleotide

SEQ ID NO: 414167 - DNA, 43 bp, Artificial Sequence; identical to SEQ ID NO: 67919
  Description of Artificial Sequence: Synthetic oligonucleotide

SEQ ID NO: 414168 - DNA, 42 bp, Artificial Sequence; identical to SEQ ID NO: 67920
  Description of Artificial Sequence: Synthetic oligonucleotide

SEQ ID NO: 414169 - DNA, 25 bp, Artificial Sequence
  Description of Artificial Sequence: Synthetic oligonucleotide
tgcgcttcgacagcgacgtggggaa

SEQ ID NO: 414170 - DNA, 24 bp, Artificial Sequence
  Description of Artificial Sequence: Synthetic oligonucleotide
gcgcttcgacagcgacgtggggaa

SEQ ID NO: 414171 - DNA, 26 bp, Artificial Sequence
  Description of Artificial Sequence: Synthetic oligonucleotide
cgcttcgacagcgacgtggggaagta

SEQ ID NO: 414172 - DNA, 26 bp, Artificial Sequence
  Description of Artificial Sequence: Synthetic oligonucleotide
gcttcgacagcgacgtggggaagtac

SEQ ID NO: 414173 - DNA, 26 bp, Artificial Sequence
  Description of Artificial Sequence: Synthetic oligonucleotide
cttcgacagcgacgtggggaagtacc

SEQ ID NO: 414174 - DNA, 26 bp, Artificial Sequence
  Description of Artificial Sequence: Synthetic oligonucleotide
ttcgacagcgacgtggggaagtaccg

SEQ ID NO: 414175 - DNA, 25 bp, Artificial Sequence
  Description of Artificial Sequence: Synthetic oligonucleotide
tcgacagcgacgtggggaagtaccg

SEQ ID NO: 414176 - DNA, 24 bp, Artificial Sequence
  Description of Artificial Sequence: Synthetic oligonucleotide
cgacagcgacgtggggaagtaccg

SEQ ID NO: 414177 - DNA, 24 bp, Artificial Sequence
  Description of Artificial Sequence: Synthetic oligonucleotide
gacagcgacgtggggaagtaccgg

SEQ ID NO: 414178 - DNA, 24 bp, Artificial Sequence
  Description of Artificial Sequence: Synthetic oligonucleotide
acagcgacgtggggaagtaccggg

SEQ ID NO: 414179 - DNA, 23 bp, Artificial Sequence
  Description of Artificial Sequence: Synthetic oligonucleotide
cagcgacgtggggaagtaccggg

SEQ ID NO: 414180 - DNA, 23 bp, Artificial Sequence
  Description of Artificial Sequence: Synthetic oligonucleotide
agcgacgtggggaagtaccgggc

SEQ ID NO: 414181 - DNA, 22 bp, Artificial Sequence
  Description of Artificial Sequence: Synthetic oligonucleotide
gcgacgtggggaagtaccgggc

SEQ ID NO: 414182 - DNA, 22 bp, Artificial Sequence
  Description of Artificial Sequence: Synthetic oligonucleotide
cgacgtggggaagtaccgggcg

SEQ ID NO: 414183 - DNA, 23 bp, Artificial Sequence
  Description of Artificial Sequence: Synthetic oligonucleotide
gacgtggggaagtaccgggcggt

SEQ ID NO: 414184 - DNA, 24 bp, Artificial Sequence
  Description of Artificial Sequence: Synthetic oligonucleotide
acgtggggaagtaccgggcggtga

SEQ ID NO: 414185 - DNA, 23 bp, Artificial Sequence
  Description of Artificial Sequence: Synthetic oligonucleotide
cgtggggaagtaccgggcggtga

SEQ ID NO: 414186 - DNA, 23 bp, Artificial Sequence
  Description of Artificial Sequence: Synthetic oligonucleotide
gtggggaagtaccgggcggtgac

SEQ ID NO: 414187 - DNA, 23 bp, Artificial Sequence
  Description of Artificial Sequence: Synthetic oligonucleotide
tggggaagtaccgggcggtgacg

SEQ ID NO: 414188 - DNA, 22 bp, Artificial Sequence
  Description of Artificial Sequence: Synthetic oligonucleotide
ggggaagtaccgggcggtgacg

SEQ ID NO: 414189 - DNA, 23 bp, Artificial Sequence
  Description of Artificial Sequence: Synthetic oligonucleotide
gggaagtaccgggcggtgacgga

SEQ ID NO: 414190 - DNA, 23 bp, Artificial Sequence
  Description of Artificial Sequence: Synthetic oligonucleotide
ggaagtaccgggcggtgacggag

SEQ ID NO: 414191 - DNA, 24 bp, Artificial Sequence
  Description of Artificial Sequence: Synthetic oligonucleotide
gaagtaccgggcggtgacggagct

SEQ ID NO: 414192 - DNA, 24 bp, Artificial Sequence
  Description of Artificial Sequence: Synthetic oligonucleotide
aagtaccgggcggtgacggagctg

SEQ ID NO: 414193 - DNA, 31 bp, Artificial Sequence; identical to SEQ ID NO: 67945
  Description of Artificial Sequence: Synthetic oligonucleotide

SEQ ID NO: 414194 - DNA, 30 bp, Artificial Sequence; identical to SEQ ID NO: 67946
  Description of Artificial Sequence: Synthetic oligonucleotide

SEQ ID NO: 414195 - DNA, 31 bp, Artificial Sequence; identical to SEQ ID NO: 67947
  Description of Artificial Sequence: Synthetic oligonucleotide

SEQ ID NO: 414196 - DNA, 30 bp, Artificial Sequence; identical to SEQ ID NO: 67948
  Description of Artificial Sequence: Synthetic oligonucleotide

SEQ ID NO: 414197 - DNA, 31 bp, Artificial Sequence; identical to SEQ ID NO: 67949
  Description of Artificial Sequence: Synthetic oligonucleotide

SEQ ID NO: 414198 - DNA, 32 bp, Artificial Sequence; identical to SEQ ID NO: 67950
  Description of Artificial Sequence: Synthetic oligonucleotide

SEQ ID NO: 414199 - DNA, 31 bp, Artificial Sequence; identical to SEQ ID NO: 67951
  Description of Artificial Sequence: Synthetic oligonucleotide

SEQ ID NO: 414200 - DNA, 30 bp, Artificial Sequence; identical to SEQ ID NO: 67952
  Description of Artificial Sequence: Synthetic oligonucleotide

SEQ ID NO: 414201 - DNA, 30 bp, Artificial Sequence; identical to SEQ ID NO: 67953
  Description of Artificial Sequence: Synthetic oligonucleotide

SEQ ID NO: 414202 - DNA, 29 bp, Artificial Sequence
  Description of Artificial Sequence: Synthetic oligonucleotide
gcagatacaactacggggttggtgagagc

SEQ ID NO: 414203 - DNA, 31 bp, Artificial Sequence; identical to SEQ ID NO: 67955
  Description of Artificial Sequence: Synthetic oligonucleotide

SEQ ID NO: 414204 - DNA, 32 bp, Artificial Sequence; identical to SEQ ID NO: 67956
  Description of Artificial Sequence: Synthetic oligonucleotide

SEQ ID NO: 414205 - DNA, 31 bp, Artificial Sequence; identical to SEQ ID NO: 67957
  Description of Artificial Sequence: Synthetic oligonucleotide

SEQ ID NO: 414206 - DNA, 32 bp, Artificial Sequence; identical to SEQ ID NO: 67958
  Description of Artificial Sequence: Synthetic oligonucleotide

SEQ ID NO: 414207 - DNA, 31 bp, Artificial Sequence; identical to SEQ ID NO: 67959
  Description of Artificial Sequence: Synthetic oligonucleotide

SEQ ID NO: 414208 - DNA, 23 bp, Artificial Sequence
  Description of Artificial Sequence: Synthetic oligonucleotide
atcctggagcagaggcgggccga

SEQ ID NO: 414209 - DNA, 22 bp, Artificial Sequence
  Description of Artificial Sequence: Synthetic oligonucleotide
cgcttcgacagcgacgtggggg

SEQ ID NO: 414210 - DNA, 22 bp, Artificial Sequence
  Description of Artificial Sequence: Synthetic oligonucleotide
gcttcgacagcgacgtgggggg

SEQ ID NO: 414211 - DNA, 24 bp, Artificial Sequence
  Description of Artificial Sequence: Synthetic oligonucleotide
cttcgacagcgacgtgggggggta

SEQ ID NO: 414212 - DNA, 24 bp, Artificial Sequence
  Description of Artificial Sequence: Synthetic oligonucleotide
ttcgacagcgacgtgggggggtac

SEQ ID NO: 414213 - DNA, 23 bp, Artificial Sequence
  Description of Artificial Sequence: Synthetic oligonucleotide
tcgacagcgacgtgggggggtac

SEQ ID NO: 414214 - DNA, 22 bp, Artificial Sequence
  Description of Artificial Sequence: Synthetic oligonucleotide
cgacagcgacgtgggggggtac

SEQ ID NO: 414215 - DNA, 22 bp, Artificial Sequence
  Description of Artificial Sequence: Synthetic oligonucleotide
gacagcgacgtgggggggtacc

SEQ ID NO: 414216 - DNA, 22 bp, Artificial Sequence
  Description of Artificial Sequence: Synthetic oligonucleotide
acagcgacgtgggggggtaccg

SEQ ID NO: 414217 - DNA, 21 bp, Artificial Sequence
  Description of Artificial Sequence: Synthetic oligonucleotide
cagcgacgtgggggggtaccg

SEQ ID NO: 414218 - DNA, 21 bp, Artificial Sequence
  Description of Artificial Sequence: Synthetic oligonucleotide
agcgacgtgggggggtaccgg

SEQ ID NO: 414219 - DNA, 20 bp, Artificial Sequence
  Description of Artificial Sequence: Synthetic oligonucleotide
gcgacgtgggggggtaccgg

SEQ ID NO: 414220 - DNA, 20 bp, Artificial Sequence
  Description of Artificial Sequence: Synthetic oligonucleotide
cgacgtgggggggtaccggg

SEQ ID NO: 414221 - DNA, 20 bp, Artificial Sequence
  Description of Artificial Sequence: Synthetic oligonucleotide
gacgtgggggggtaccgggc

SEQ ID NO: 414222 - DNA, 20 bp, Artificial Sequence
  Description of Artificial Sequence: Synthetic oligonucleotide
acgtgggggggtaccgggcg

SEQ ID NO: 414223 - DNA, 20 bp, Artificial Sequence
  Description of Artificial Sequence: Synthetic oligonucleotide
cgtgggggggtaccgggcgt

SEQ ID NO: 414224 - DNA, 20 bp, Artificial Sequence
  Description of Artificial Sequence: Synthetic oligonucleotide
gtgggggggtaccgggcggt

SEQ ID NO: 414225 - DNA, 21 bp, Artificial Sequence
  Description of Artificial Sequence: Synthetic oligonucleotide
tgggggggtaccgggcggtga

SEQ ID NO: 414226 - DNA, 20 bp, Artificial Sequence
  Description of Artificial Sequence: Synthetic oligonucleotide
gggggggtaccgggcggtga

SEQ ID NO: 414227 - DNA, 20 bp, Artificial Sequence
  Description of Artificial Sequence: Synthetic oligonucleotide
ggggggtaccgggcggtgac

SEQ ID NO: 414228 - DNA, 20 bp, Artificial Sequence
  Description of Artificial Sequence: Synthetic oligonucleotide
gggggtaccgggcggtgacg

SEQ ID NO: 414229 - DNA, 21 bp, Artificial Sequence
  Description of Artificial Sequence: Synthetic oligonucleotide
ggggtaccgggcggtgacgga

SEQ ID NO: 414230 - DNA, 21 bp, Artificial Sequence
  Description of Artificial Sequence: Synthetic oligonucleotide
gggtaccgggcggtgacggag

SEQ ID NO: 414231 - DNA, 22 bp, Artificial Sequence
  Description of Artificial Sequence: Synthetic oligonucleotide
ggtaccgggcggtgacggagct

SEQ ID NO: 414232 - DNA, 27 bp, Artificial Sequence
  Description of Artificial Sequence: Synthetic oligonucleotide
agatgctgagtggagtcgggggcttca

SEQ ID NO: 414233 - DNA, 27 bp, Artificial Sequence
  Description of Artificial Sequence: Synthetic oligonucleotide
gatgctgagtggagtcgggggcttcat

SEQ ID NO: 414234 - DNA, 27 bp, Artificial Sequence
  Description of Artificial Sequence: Synthetic oligonucleotide
atgctgagtggagtcgggggcttcatg

SEQ ID NO: 414235 - DNA, 26 bp, Artificial Sequence
  Description of Artificial Sequence: Synthetic oligonucleotide
tgctgagtggagtcgggggcttcatg

SEQ ID NO: 414236 - DNA, 25 bp, Artificial Sequence
  Description of Artificial Sequence: Synthetic oligonucleotide
gctgagtggagtcgggggcttcatg

SEQ ID NO: 414237 - DNA, 26 bp, Artificial Sequence
  Description of Artificial Sequence: Synthetic oligonucleotide
ctgagtggagtcgggggcttcatgct

SEQ ID NO: 414238 - DNA, 26 bp, Artificial Sequence
  Description of Artificial Sequence: Synthetic oligonucleotide
tgagtggagtcgggggcttcatgctg

SEQ ID NO: 414239 - DNA, 25 bp, Artificial Sequence
  Description of Artificial Sequence: Synthetic oligonucleotide
gagtggagtcgggggcttcatgctg

SEQ ID NO: 414240 - DNA, 25 bp, Artificial Sequence
  Description of Artificial Sequence: Synthetic oligonucleotide
agtggagtcgggggcttcatgctgg

SEQ ID NO: 414241 - DNA, 24 bp, Artificial Sequence
  Description of Artificial Sequence: Synthetic oligonucleotide
gtggagtcgggggcttcatgctgg

SEQ ID NO: 414242 - DNA, 24 bp, Artificial Sequence
  Description of Artificial Sequence: Synthetic oligonucleotide
tggagtcgggggcttcatgctggg

SEQ ID NO: 414243 - DNA, 23 bp, Artificial Sequence
  Description of Artificial Sequence: Synthetic oligonucleotide
ggagtcgggggcttcatgctggg

SEQ ID NO: 414244 - DNA, 23 bp, Artificial Sequence
  Description of Artificial Sequence: Synthetic oligonucleotide
gagtcgggggcttcatgctgggc

SEQ ID NO: 414245 - DNA, 24 bp, Artificial Sequence
  Description of Artificial Sequence: Synthetic oligonucleotide
agtcgggggcttcatgctgggcct

SEQ ID NO: 414246 - DNA, 23 bp, Artificial Sequence
  Description of Artificial Sequence: Synthetic oligonucleotide
gtcgggggcttcatgctgggcct

SEQ ID NO: 414247 - DNA, 23 bp, Artificial Sequence
  Description of Artificial Sequence: Synthetic oligonucleotide
tcgggggcttcatgctgggcctg

SEQ ID NO: 414248 - DNA, 22 bp, Artificial Sequence
  Description of Artificial Sequence: Synthetic oligonucleotide
cgggggcttcatgctgggcctg

SEQ ID NO: 414249 - DNA, 23 bp, Artificial Sequence
  Description of Artificial Sequence: Synthetic oligonucleotide
gggggcttcatgctgggcctgct

SEQ ID NO: 414250 - DNA, 25 bp, Artificial Sequence
  Description of Artificial Sequence: Synthetic oligonucleotide
ggggcttcatgctgggcctgctctt

SEQ ID NO: 414251 - DNA, 25 bp, Artificial Sequence
  Description of Artificial Sequence: Synthetic oligonucleotide
gggcttcatgctgggcctgctcttc

SEQ ID NO: 414252 - DNA, 27 bp, Artificial Sequence
  Description of Artificial Sequence: Synthetic oligonucleotide
ggcttcatgctgggcctgctcttcctt

SEQ ID NO: 414253 - DNA, 27 bp, Artificial Sequence
  Description of Artificial Sequence: Synthetic oligonucleotide
gcttcatgctgggcctgctcttccttg

SEQ ID NO: 414254 - DNA, 27 bp, Artificial Sequence
  Description of Artificial Sequence: Synthetic oligonucleotide
cttcatgctgggcctgctcttccttgg

SEQ ID NO: 414255 - DNA, 27 bp, Artificial Sequence
  Description of Artificial Sequence: Synthetic oligonucleotide
ttcatgctgggcctgctcttccttggg

SEQ ID NO: 414256 - DNA, 26 bp, Artificial Sequence
  Description of Artificial Sequence: Synthetic oligonucleotide
tcatgctgggcctgctcttccttggg

SEQ ID NO: 414257 - DNA, 25 bp, Artificial Sequence
  Description of Artificial Sequence: Synthetic oligonucleotide
catgctgggcctgctcttccttggg

SEQ ID NO: 414258 - DNA, 25 bp, Artificial Sequence
  Description of Artificial Sequence: Synthetic oligonucleotide
atgctgggcctgctcttccttgggg

SEQ ID NO: 414259 - DNA, 27 bp, Artificial Sequence
  Description of Artificial Sequence: Synthetic oligonucleotide
ccgagtactggaacagccagaaggacg

SEQ ID NO: 414260 - DNA, 28 bp, Artificial Sequence
  Description of Artificial Sequence: Synthetic oligonucleotide
cgagtactggaacagccagaaggacgtc

SEQ ID NO: 414261 - DNA, 28 bp, Artificial Sequence
  Description of Artificial Sequence: Synthetic oligonucleotide
gagtactggaacagccagaaggacgtcc

SEQ ID NO: 414262 - DNA, 29 bp, Artificial Sequence
  Description of Artificial Sequence: Synthetic oligonucleotide
agtactggaacagccagaaggacgtcctg

SEQ ID NO: 414263 - DNA, 28 bp, Artificial Sequence
  Description of Artificial Sequence: Synthetic oligonucleotide
gtactggaacagccagaaggacgtcctg

SEQ ID NO: 414264 - DNA, 28 bp, Artificial Sequence
  Description of Artificial Sequence: Synthetic oligonucleotide
tactggaacagccagaaggacgtcctgg

SEQ ID NO: 414265 - DNA, 27 bp, Artificial Sequence
  Description of Artificial Sequence: Synthetic oligonucleotide
actggaacagccagaaggacgtcctgg

SEQ ID NO: 414266 - DNA, 27 bp, Artificial Sequence
  Description of Artificial Sequence: Synthetic oligonucleotide
ctggaacagccagaaggacgtcctgga

SEQ ID NO: 414267 - DNA, 27 bp, Artificial Sequence
  Description of Artificial Sequence: Synthetic oligonucleotide
tggaacagccagaaggacgtcctggag

SEQ ID NO: 414268 - DNA, 26 bp, Artificial Sequence
  Description of Artificial Sequence: Synthetic oligonucleotide
ggaacagccagaaggacgtcctggag

SEQ ID NO: 414269 - DNA, 27 bp, Artificial Sequence
  Description of Artificial Sequence: Synthetic oligonucleotide
gaacagccagaaggacgtcctggagca

SEQ ID NO: 414270 - DNA, 27 bp, Artificial Sequence
  Description of Artificial Sequence: Synthetic oligonucleotide
aacagccagaaggacgtcctggagcag

SEQ ID NO: 414271 - DNA, 27 bp, Artificial Sequence
  Description of Artificial Sequence: Synthetic oligonucleotide
acagccagaaggacgtcctggagcaga

SEQ ID NO: 414272 - DNA, 26 bp, Artificial Sequence
  Description of Artificial Sequence: Synthetic oligonucleotide
cagccagaaggacgtcctggagcaga

SEQ ID NO: 414273 - DNA, 26 bp, Artificial Sequence
  Description of Artificial Sequence: Synthetic oligonucleotide
agccagaaggacgtcctggagcagag

SEQ ID NO: 414274 - DNA, 25 bp, Artificial Sequence
  Description of Artificial Sequence: Synthetic oligonucleotide
gccagaaggacgtcctggagcagag

SEQ ID NO: 414275 - DNA, 25 bp, Artificial Sequence
  Description of Artificial Sequence: Synthetic oligonucleotide
ccagaaggacgtcctggagcagagg

SEQ ID NO: 414276 - DNA, 25 bp, Artificial Sequence
  Description of Artificial Sequence: Synthetic oligonucleotide
cagaaggacgtcctggagcagaggc

SEQ ID NO: 414277 - DNA, 25 bp, Artificial Sequence
  Description of Artificial Sequence: Synthetic oligonucleotide
agaaggacgtcctggagcagaggcg

SEQ ID NO: 414278 - DNA, 24 bp, Artificial Sequence
  Description of Artificial Sequence: Synthetic oligonucleotide
gaaggacgtcctggagcagaggcg

SEQ ID NO: 414279 - DNA, 24 bp, Artificial Sequence
  Description of Artificial Sequence: Synthetic oligonucleotide
aaggacgtcctggagcagaggcgg

SEQ ID NO: 414280 - DNA, 23 bp, Artificial Sequence
  Description of Artificial Sequence: Synthetic oligonucleotide
aggacgtcctggagcagaggcgg

SEQ ID NO: 414281 - DNA, 22 bp, Artificial Sequence
  Description of Artificial Sequence: Synthetic oligonucleotide
ggacgtcctggagcagaggcgg

SEQ ID NO: 414282 - DNA, 22 bp, Artificial Sequence
  Description of Artificial Sequence: Synthetic oligonucleotide
gacgtcctggagcagaggcggg

SEQ ID NO: 414283 - DNA, 22 bp, Artificial Sequence
  Description of Artificial Sequence: Synthetic oligonucleotide
acgtcctggagcagaggcgggc

SEQ ID NO: 414284 - DNA, 21 bp, Artificial Sequence
  Description of Artificial Sequence: Synthetic oligonucleotide
cgtcctggagcagaggcgggc

SEQ ID NO: 414285 - DNA, 21 bp, Artificial Sequence
  Description of Artificial Sequence: Synthetic oligonucleotide
gtcctggagcagaggcgggcc

SEQ ID NO: 414286 - DNA, 33 bp, Artificial Sequence
  Description of Artificial Sequence: Synthetic oligonucleotide
ttctatcaccaagaggagtacgtgcgcttcaac

SEQ ID NO: 414287 - DNA, 32 bp, Artificial Sequence
  Description of Artificial Sequence: Synthetic oligonucleotide
tctatcaccaagaggagtacgtgcgcttcaac

SEQ ID NO: 414288 - DNA, 31 bp, Artificial Sequence
  Description of Artificial Sequence: Synthetic oligonucleotide
ctatcaccaagaggagtacgtgcgcttcaac

SEQ ID NO: 414289 - DNA, 32 bp, Artificial Sequence
  Description of Artificial Sequence: Synthetic oligonucleotide
tatcaccaagaggagtacgtgcgcttcaacag

SEQ ID NO: 414290 - DNA, 31 bp, Artificial Sequence
  Description of Artificial Sequence: Synthetic oligonucleotide
atcaccaagaggagtacgtgcgcttcaacag

SEQ ID NO: 414291 - DNA, 30 bp, Artificial Sequence
  Description of Artificial Sequence: Synthetic oligonucleotide
tcaccaagaggagtacgtgcgcttcaacag

SEQ ID NO: 414292 - DNA, 29 bp, Artificial Sequence
  Description of Artificial Sequence: Synthetic oligonucleotide
caccaagaggagtacgtgcgcttcaacag

SEQ ID NO: 414293 - DNA, 29 bp, Artificial Sequence
  Description of Artificial Sequence: Synthetic oligonucleotide
accaagaggagtacgtgcgcttcaacagc

SEQ ID NO: 414294 - DNA, 28 bp, Artificial Sequence
  Description of Artificial Sequence: Synthetic oligonucleotide
ccaagaggagtacgtgcgcttcaacagc

SEQ ID NO: 414295 - DNA, 28 bp, Artificial Sequence
  Description of Artificial Sequence: Synthetic oligonucleotide
caagaggagtacgtgcgcttcaacagcg

SEQ ID NO: 414296 - DNA, 29 bp, Artificial Sequence
  Description of Artificial Sequence: Synthetic oligonucleotide
aagaggagtacgtgcgcttcaacagcgac

SEQ ID NO: 414297 - DNA, 28 bp, Artificial Sequence
  Description of Artificial Sequence: Synthetic oligonucleotide
agaggagtacgtgcgcttcaacagcgac

SEQ ID NO: 414298 - DNA, 27 bp, Artificial Sequence
  Description of Artificial Sequence: Synthetic oligonucleotide
gaggagtacgtgcgcttcaacagcgac

SEQ ID NO: 414299 - DNA, 27 bp, Artificial Sequence
  Description of Artificial Sequence: Synthetic oligonucleotide
aggagtacgtgcgcttcaacagcgacg

SEQ ID NO: 414300 - DNA, 27 bp, Artificial Sequence
  Description of Artificial Sequence: Synthetic oligonucleotide
ggagtacgtgcgcttcaacagcgacgt

SEQ ID NO: 414301 - DNA, 27 bp, Artificial Sequence
  Description of Artificial Sequence: Synthetic oligonucleotide
gagtacgtgcgcttcaacagcgacgtg

SEQ ID NO: 414302 - DNA, 27 bp, Artificial Sequence
  Description of Artificial Sequence: Synthetic oligonucleotide
agtacgtgcgcttcaacagcgacgtgg

SEQ ID NO: 414303 - DNA, 26 bp, Artificial Sequence
  Description of Artificial Sequence: Synthetic oligonucleotide
gtacgtgcgcttcaacagcgacgtgg

SEQ ID NO: 414304 - DNA, 26 bp, Artificial Sequence
  Description of Artificial Sequence: Synthetic oligonucleotide
tacgtgcgcttcaacagcgacgtggg

SEQ ID NO: 414305 - DNA, 25 bp, Artificial Sequence
  Description of Artificial Sequence: Synthetic oligonucleotide
acgtgcgcttcaacagcgacgtggg

SEQ ID NO: 414306 - DNA, 24 bp, Artificial Sequence
  Description of Artificial Sequence: Synthetic oligonucleotide
cgtgcgcttcaacagcgacgtggg

SEQ ID NO: 414307 - DNA, 24 bp, Artificial Sequence
  Description of Artificial Sequence: Synthetic oligonucleotide
gtgcgcttcaacagcgacgtgggg

SEQ ID NO: 414308 - DNA, 25 bp, Artificial Sequence
  Description of Artificial Sequence: Synthetic oligonucleotide
tgcgcttcaacagcgacgtggggga

SEQ ID NO: 414309 - DNA, 24 bp, Artificial Sequence
  Description of Artificial Sequence: Synthetic oligonucleotide
gcgcttcaacagcgacgtggggga

SEQ ID NO: 414310 - DNA, 26 bp, Artificial Sequence
  Description of Artificial Sequence: Synthetic oligonucleotide
cgcttcaacagcgacgtgggggagta

SEQ ID NO: 414311 - DNA, 26 bp, Artificial Sequence
  Description of Artificial Sequence: Synthetic oligonucleotide
gcttcaacagcgacgtgggggagtac

SEQ ID NO: 414312 - DNA, 26 bp, Artificial Sequence
  Description of Artificial Sequence: Synthetic oligonucleotide
cttcaacagcgacgtgggggagtacc

SEQ ID NO: 414313 - DNA, 26 bp, Artificial Sequence
  Description of Artificial Sequence: Synthetic oligonucleotide
ttcaacagcgacgtgggggagtaccg

SEQ ID NO: 414314 - DNA, 25 bp, Artificial Sequence
  Description of Artificial Sequence: Synthetic oligonucleotide
tcaacagcgacgtgggggagtaccg

SEQ ID NO: 414315 - DNA, 24 bp, Artificial Sequence
  Description of Artificial Sequence: Synthetic oligonucleotide
caacagcgacgtgggggagtaccg

SEQ ID NO: 414316 - DNA, 24 bp, Artificial Sequence
  Description of Artificial Sequence: Synthetic oligonucleotide
aacagcgacgtgggggagtaccgg

SEQ ID NO: 414317 - DNA, 26 bp, Artificial Sequence
  Description of Artificial Sequence: Synthetic oligonucleotide
ccagaaggacctcctggagcagaggt

SEQ ID NO: 414318 - DNA, 26 bp, Artificial Sequence
  Description of Artificial Sequence: Synthetic oligonucleotide
cagaaggacctcctggagcagaggtg

SEQ ID NO: 414319 - DNA, 26 bp, Artificial Sequence
  Description of Artificial Sequence: Synthetic oligonucleotide
agaaggacctcctggagcagaggtgg

SEQ ID NO: 414320 - DNA, 25 bp, Artificial Sequence
  Description of Artificial Sequence: Synthetic oligonucleotide
gaaggacctcctggagcagaggtgg

SEQ ID NO: 414321 - DNA, 25 bp, Artificial Sequence
  Description of Artificial Sequence: Synthetic oligonucleotide
aaggacctcctggagcagaggtggg

SEQ ID NO: 414322 - DNA, 24 bp, Artificial Sequence
  Description of Artificial Sequence: Synthetic oligonucleotide
aggacctcctggagcagaggtggg

SEQ ID NO: 414323 - DNA, 23 bp, Artificial Sequence
  Description of Artificial Sequence: Synthetic oligonucleotide
ggacctcctggagcagaggtggg

SEQ ID NO: 414324 - DNA, 23 bp, Artificial Sequence
  Description of Artificial Sequence: Synthetic oligonucleotide
gacctcctggagcagaggtgggc

SEQ ID NO: 414325 - DNA, 23 bp, Artificial Sequence
  Description of Artificial Sequence: Synthetic oligonucleotide
acctcctggagcagaggtgggcc

SEQ ID NO: 414326 - DNA, 22 bp, Artificial Sequence
  Description of Artificial Sequence: Synthetic oligonucleotide
cctcctggagcagaggtgggcc

SEQ ID NO: 414327 - DNA, 23 bp, Artificial Sequence
  Description of Artificial Sequence: Synthetic oligonucleotide
ctcctggagcagaggtgggccga

SEQ ID NO: 414328 - DNA, 23 bp, Artificial Sequence
  Description of Artificial Sequence: Synthetic oligonucleotide
tcctggagcagaggtgggccgag

SEQ ID NO: 414329 - DNA, 22 bp, Artificial Sequence
  Description of Artificial Sequence: Synthetic oligonucleotide
cctggagcagaggtgggccgag

SEQ ID NO: 414330 - DNA, 23 bp, Artificial Sequence
  Description of Artificial Sequence: Synthetic oligonucleotide
ctggagcagaggtgggccgaggt

SEQ ID NO: 414331 - DNA, 23 bp, Artificial Sequence
  Description of Artificial Sequence: Synthetic oligonucleotide
tggagcagaggtgggccgaggtg

SEQ ID NO: 414332 - DNA, 22 bp, Artificial Sequence
  Description of Artificial Sequence: Synthetic oligonucleotide
ggagcagaggtgggccgaggtg

SEQ ID NO: 414333 - DNA, 23 bp, Artificial Sequence
  Description of Artificial Sequence: Synthetic oligonucleotide
gagcagaggtgggccgaggtgga

SEQ ID NO: 414334 - DNA, 24 bp, Artificial Sequence
  Description of Artificial Sequence: Synthetic oligonucleotide
agcagaggtgggccgaggtggaca

SEQ ID NO: 414335 - DNA, 23 bp, Artificial Sequence
  Description of Artificial Sequence: Synthetic oligonucleotide
gcagaggtgggccgaggtggaca

SEQ ID NO: 414336 - DNA, 23 bp, Artificial Sequence
  Description of Artificial Sequence: Synthetic oligonucleotide
cagaggtgggccgaggtggacac

SEQ ID NO: 414337 - DNA, 25 bp, Artificial Sequence
  Description of Artificial Sequence: Synthetic oligonucleotide
agaggtgggccgaggtggacaccta

SEQ ID NO: 414338 - DNA, 24 bp, Artificial Sequence
  Description of Artificial Sequence: Synthetic oligonucleotide
gaggtgggccgaggtggacaccta

SEQ ID NO: 414339 - DNA, 25 bp, Artificial Sequence
  Description of Artificial Sequence: Synthetic oligonucleotide
aggtgggccgaggtggacacctact

SEQ ID NO: 414340 - DNA, 24 bp, Artificial Sequence
  Description of Artificial Sequence: Synthetic oligonucleotide
ggtgggccgaggtggacacctact

SEQ ID NO: 414341 - DNA, 24 bp, Artificial Sequence
  Description of Artificial Sequence: Synthetic oligonucleotide
gtgggccgaggtggacacctactg

SEQ ID NO: 414342 - DNA, 25 bp, Artificial Sequence
  Description of Artificial Sequence: Synthetic oligonucleotide
tgggccgaggtggacacctactgca

SEQ ID NO: 414343 - DNA, 21 bp, Artificial Sequence
  Description of Artificial Sequence: Synthetic oligonucleotide
ctggagcagaagcggggccgc

SEQ ID NO: 414344 - DNA, 22 bp, Artificial Sequence
  Description of Artificial Sequence: Synthetic oligonucleotide
tggagcagaagcggggccgcgt

SEQ ID NO: 414345 - DNA, 21 bp, Artificial Sequence
  Description of Artificial Sequence: Synthetic oligonucleotide
ggagcagaagcggggccgcgt

SEQ ID NO: 414346 - DNA, 21 bp, Artificial Sequence
  Description of Artificial Sequence: Synthetic oligonucleotide
gagcagaagcggggccgcgtg

SEQ ID NO: 414347 - DNA, 22 bp, Artificial Sequence
  Description of Artificial Sequence: Synthetic oligonucleotide
agcagaagcggggccgcgtgga

SEQ ID NO: 414348 - DNA, 21 bp, Artificial Sequence
  Description of Artificial Sequence: Synthetic oligonucleotide
gcagaagcggggccgcgtgga

SEQ ID NO: 414349 - DNA, 22 bp, Artificial Sequence
  Description of Artificial Sequence: Synthetic oligonucleotide
cagaagcggggccgcgtggaca

SEQ ID NO: 414350 - DNA, 22 bp, Artificial Sequence
  Description of Artificial Sequence: Synthetic oligonucleotide
agaagcggggccgcgtggacac

SEQ ID NO: 414351 - DNA, 21 bp, Artificial Sequence
  Description of Artificial Sequence: Synthetic oligonucleotide
gaagcggggccgcgtggacac

SEQ ID NO: 414352 - DNA, 23 bp, Artificial Sequence
  Description of Artificial Sequence: Synthetic oligonucleotide
aagcggggccgcgtggacaccta

SEQ ID NO: 414353 - DNA, 22 bp, Artificial Sequence
  Description of Artificial Sequence: Synthetic oligonucleotide
agcggggccgcgtggacaccta

SEQ ID NO: 414354 - DNA, 21 bp, Artificial Sequence
  Description of Artificial Sequence: Synthetic oligonucleotide
gcggggccgcgtggacaccta

SEQ ID NO: 414355 - DNA, 22 bp, Artificial Sequence
  Description of Artificial Sequence: Synthetic oligonucleotide
cggggccgcgtggacacctact

SEQ ID NO: 414356 - DNA, 22 bp, Artificial Sequence
  Description of Artificial Sequence: Synthetic oligonucleotide
ggggccgcgtggacacctactg

SEQ ID NO: 414357 - DNA, 23 bp, Artificial Sequence
  Description of Artificial Sequence: Synthetic oligonucleotide
gggccgcgtggacacctactgca

SEQ ID NO: 414358 - DNA, 24 bp, Artificial Sequence
  Description of Artificial Sequence: Synthetic oligonucleotide
ggccgcgtggacacctactgcaga

SEQ ID NO: 414359 - DNA, 25 bp, Artificial Sequence
  Description of Artificial Sequence: Synthetic oligonucleotide
gccgcgtggacacctactgcagaca

SEQ ID NO: 414360 - DNA, 27 bp, Artificial Sequence
  Description of Artificial Sequence: Synthetic oligonucleotide
ccgcgtggacacctactgcagacacaa

SEQ ID NO: 414361 - DNA, 27 bp, Artificial Sequence
  Description of Artificial Sequence: Synthetic oligonucleotide
cgcgtggacacctactgcagacacaac

SEQ ID NO: 414362 - DNA, 29 bp, Artificial Sequence
  Description of Artificial Sequence: Synthetic oligonucleotide
gcgtggacacctactgcagacacaactac

SEQ ID NO: 414363 - DNA, 29 bp, Artificial Sequence
  Description of Artificial Sequence: Synthetic oligonucleotide
cgtggacacctactgcagacacaactacg

SEQ ID NO: 414364 - DNA, 32 bp, Artificial Sequence; identical to SEQ ID NO: 70120
  Description of Artificial Sequence: Synthetic oligonucleotide

SEQ ID NO: 414365 - DNA, 31 bp, Artificial Sequence; identical to SEQ ID NO: 70121
  Description of Artificial Sequence: Synthetic oligonucleotide

SEQ ID NO: 414366 - DNA, 31 bp, Artificial Sequence; identical to SEQ ID NO: 70122
  Description of Artificial Sequence: Synthetic oligonucleotide

SEQ ID NO: 414367 - DNA, 30 bp, Artificial Sequence; identical to SEQ ID NO: 70123
  Description of Artificial Sequence: Synthetic oligonucleotide

SEQ ID NO: 414368 - DNA, 31 bp, Artificial Sequence; identical to SEQ ID NO: 70124
  Description of Artificial Sequence: Synthetic oligonucleotide

SEQ ID NO: 414369 - DNA, 32 bp, Artificial Sequence; identical to SEQ ID NO: 70125
  Description of Artificial Sequence: Synthetic oligonucleotide

SEQ ID NO: 414370 - DNA, 31 bp, Artificial Sequence; identical to SEQ ID NO: 70126
  Description of Artificial Sequence: Synthetic oligonucleotide

SEQ ID NO: 414371 - DNA, 30 bp, Artificial Sequence; identical to SEQ ID NO: 70127
  Description of Artificial Sequence: Synthetic oligonucleotide

SEQ ID NO: 414372 - DNA, 38 bp, Artificial Sequence
  Description of Artificial Sequence: Synthetic oligonucleotide
gcatccacagaatcacagcattttccagtattgaaagg

SEQ ID NO: 414373 - DNA, 38 bp, Artificial Sequence
  Description of Artificial Sequence: Synthetic oligonucleotide
catccacagaatcacagcattttccagtattgaaaggc

SEQ ID NO: 414374 - DNA, 38 bp, Artificial Sequence
  Description of Artificial Sequence: Synthetic oligonucleotide
atccacagaatcacagcattttccagtattgaaaggcc

SEQ ID NO: 414375 - DNA, 37 bp, Artificial Sequence
  Description of Artificial Sequence: Synthetic oligonucleotide
tccacagaatcacagcattttccagtattgaaaggcc

SEQ ID NO: 414376 - DNA, 36 bp, Artificial Sequence
  Description of Artificial Sequence: Synthetic oligonucleotide
ccacagaatcacagcattttccagtattgaaaggcc

SEQ ID NO: 414377 - DNA, 37 bp, Artificial Sequence
  Description of Artificial Sequence: Synthetic oligonucleotide
cacagaatcacagcattttccagtattgaaaggcctg

SEQ ID NO: 414378 - DNA, 40 bp, Artificial Sequence
  Description of Artificial Sequence: Synthetic oligonucleotide
acagaatcacagcattttccagtattgaaaggcctgaaag

SEQ ID NO: 414379 - DNA, 39 bp, Artificial Sequence
  Description of Artificial Sequence: Synthetic oligonucleotide
cagaatcacagcattttccagtattgaaaggcctgaaag

SEQ ID NO: 414380 - DNA, 41 bp, Artificial Sequence
  Description of Artificial Sequence: Synthetic oligonucleotide
agaatcacagcattttccagtattgaaaggcctgaaagatc

SEQ ID NO: 414381 - DNA, 40 bp, Artificial Sequence
  Description of Artificial Sequence: Synthetic oligonucleotide
gaatcacagcattttccagtattgaaaggcctgaaagatc

SEQ ID NO: 414382 - DNA, 40 bp, Artificial Sequence
  Description of Artificial Sequence: Synthetic oligonucleotide
aatcacagcattttccagtattgaaaggcctgaaagatcc

SEQ ID NO: 414383 - DNA, 39 bp, Artificial Sequence
  Description of Artificial Sequence: Synthetic oligonucleotide
atcacagcattttccagtattgaaaggcctgaaagatcc

SEQ ID NO: 414384 - DNA, 38 bp, Artificial Sequence
  Description of Artificial Sequence: Synthetic oligonucleotide
tcacagcattttccagtattgaaaggcctgaaagatcc

SEQ ID NO: 414385 - DNA, 37 bp, Artificial Sequence
  Description of Artificial Sequence: Synthetic oligonucleotide
cacagcattttccagtattgaaaggcctgaaagatcc

SEQ ID NO: 414386 - DNA, 37 bp, Artificial Sequence
  Description of Artificial Sequence: Synthetic oligonucleotide
acagcattttccagtattgaaaggcctgaaagatccc

SEQ ID NO: 414387 - DNA, 36 bp, Artificial Sequence
  Description of Artificial Sequence: Synthetic oligonucleotide
cagcattttccagtattgaaaggcctgaaagatccc

SEQ ID NO: 414388 - DNA, 36 bp, Artificial Sequence
  Description of Artificial Sequence: Synthetic oligonucleotide
agcattttccagtattgaaaggcctgaaagatcccg

SEQ ID NO: 414389 - DNA, 35 bp, Artificial Sequence
  Description of Artificial Sequence: Synthetic oligonucleotide
gcattttccagtattgaaaggcctgaaagatcccg

SEQ ID NO: 414390 - DNA, 35 bp, Artificial Sequence
  Description of Artificial Sequence: Synthetic oligonucleotide
cattttccagtattgaaaggcctgaaagatcccgg

SEQ ID NO: 414391 - DNA, 36 bp, Artificial Sequence
  Description of Artificial Sequence: Synthetic oligonucleotide
attttccagtattgaaaggcctgaaagatcccggtg

SEQ ID NO: 414392 - DNA, 35 bp, Artificial Sequence
  Description of Artificial Sequence: Synthetic oligonucleotide
ttttccagtattgaaaggcctgaaagatcccggtg

SEQ ID NO: 414393 - DNA, 34 bp, Artificial Sequence
  Description of Artificial Sequence: Synthetic oligonucleotide
tttccagtattgaaaggcctgaaagatcccggtg

SEQ ID NO: 414394 - DNA, 33 bp, Artificial Sequence
  Description of Artificial Sequence: Synthetic oligonucleotide
ttccagtattgaaaggcctgaaagatcccggtg

SEQ ID NO: 414395 - DNA, 32 bp, Artificial Sequence
  Description of Artificial Sequence: Synthetic oligonucleotide
tccagtattgaaaggcctgaaagatcccggtg

SEQ ID NO: 414396 - DNA, 31 bp, Artificial Sequence
  Description of Artificial Sequence: Synthetic oligonucleotide
ccagtattgaaaggcctgaaagatcccggtg

SEQ ID NO: 414397 - DNA, 31 bp, Artificial Sequence
  Description of Artificial Sequence: Synthetic oligonucleotide
cagtattgaaaggcctgaaagatcccggtgc

SEQ ID NO: 414398 - DNA, 31 bp, Artificial Sequence
  Description of Artificial Sequence: Synthetic oligonucleotide
agtattgaaaggcctgaaagatcccggtgcc

SEQ ID NO: 414399 - DNA, 30 bp, Artificial Sequence
  Description of Artificial Sequence: Synthetic oligonucleotide
gtattgaaaggcctgaaagatcccggtgcc

SEQ ID NO: 414400 - DNA, 32 bp, Artificial Sequence
  Description of Artificial Sequence: Synthetic oligonucleotide
tattgaaaggcctgaaagatcccggtgccttc

SEQ ID NO: 414401 - DNA, 31 bp, Artificial Sequence
  Description of Artificial Sequence: Synthetic oligonucleotide
attgaaaggcctgaaagatcccggtgccttc

SEQ ID NO: 414402 - DNA, 30 bp, Artificial Sequence
  Description of Artificial Sequence: Synthetic oligonucleotide
ttgaaaggcctgaaagatcccggtgccttc

SEQ ID NO: 414403 - DNA, 29 bp, Artificial Sequence
  Description of Artificial Sequence: Synthetic oligonucleotide
tgaaaggcctgaaagatcccggtgccttc

SEQ ID NO: 414404 - DNA, 28 bp, Artificial Sequence
  Description of Artificial Sequence: Synthetic oligonucleotide
gaaaggcctgaaagatcccggtgccttc

SEQ ID NO: 414405 - DNA, 32 bp, Artificial Sequence
  Description of Artificial Sequence: Synthetic oligonucleotide
aaaggcctgaaagatcccggtgccttcatttc

SEQ ID NO: 414406 - DNA, 31 bp, Artificial Sequence
  Description of Artificial Sequence: Synthetic oligonucleotide
aaggcctgaaagatcccggtgccttcatttc

SEQ ID NO: 414407 - DNA, 30 bp, Artificial Sequence
  Description of Artificial Sequence: Synthetic oligonucleotide
aggcctgaaagatcccggtgccttcatttc

SEQ ID NO: 414408 - DNA, 29 bp, Artificial Sequence
  Description of Artificial Sequence: Synthetic oligonucleotide
ggcctgaaagatcccggtgccttcatttc

SEQ ID NO: 414409 - DNA, 31 bp, Artificial Sequence
  Description of Artificial Sequence: Synthetic oligonucleotide
gcctgaaagatcccggtgccttcatttcaac

SEQ ID NO: 414410 - DNA, 32 bp, Artificial Sequence
  Description of Artificial Sequence: Synthetic oligonucleotide
cctgaaagatcccggtgccttcatttcaactg

SEQ ID NO: 414411 - DNA, 33 bp, Artificial Sequence
  Description of Artificial Sequence: Synthetic oligonucleotide
ctgaaagatcccggtgccttcatttcaactgtg

SEQ ID NO: 414412 - DNA, 34 bp, Artificial Sequence
  Description of Artificial Sequence: Synthetic oligonucleotide
tgaaagatcccggtgccttcatttcaactgtgag

SEQ ID NO: 414413 - DNA, 33 bp, Artificial Sequence
  Description of Artificial Sequence: Synthetic oligonucleotide
gaaagatcccggtgccttcatttcaactgtgag

SEQ ID NO: 414414 - DNA, 34 bp, Artificial Sequence
  Description of Artificial Sequence: Synthetic oligonucleotide
aaagatcccggtgccttcatttcaactgtgagac

SEQ ID NO: 414415 - DNA, 33 bp, Artificial Sequence
  Description of Artificial Sequence: Synthetic oligonucleotide
aagatcccggtgccttcatttcaactgtgagac

SEQ ID NO: 414416 - DNA, 32 bp, Artificial Sequence
  Description of Artificial Sequence: Synthetic oligonucleotide
agatcccggtgccttcatttcaactgtgagac

SEQ ID NO: 414417 - DNA, 31 bp, Artificial Sequence
  Description of Artificial Sequence: Synthetic oligonucleotide
gatcccggtgccttcatttcaactgtgagac

SEQ ID NO: 414418 - DNA, 33 bp, Artificial Sequence
  Description of Artificial Sequence: Synthetic oligonucleotide
atcccggtgccttcatttcaactgtgagacatg

SEQ ID NO: 414419 - DNA, 32 bp, Artificial Sequence
  Description of Artificial Sequence: Synthetic oligonucleotide
tcccggtgccttcatttcaactgtgagacatg

SEQ ID NO: 414420 - DNA, 31 bp, Artificial Sequence
  Description of Artificial Sequence: Synthetic oligonucleotide
cccggtgccttcatttcaactgtgagacatg

SEQ ID NO: 414421 - DNA, 33 bp, Artificial Sequence
  Description of Artificial Sequence: Synthetic oligonucleotide
ccggtgccttcatttcaactgtgagacatgaag

SEQ ID NO: 414422 - DNA, 48 bp, Artificial Sequence
  Description of Artificial Sequence: Synthetic oligonucleotide
ttcatttcaactgtgagacatgaagtaattttcccaaatctacaacag

SEQ ID NO: 414423 - DNA, 47 bp, Artificial Sequence
  Description of Artificial Sequence: Synthetic oligonucleotide
tcatttcaactgtgagacatgaagtaattttcccaaatctacaacag

SEQ ID NO: 414424 - DNA, 46 bp, Artificial Sequence
  Description of Artificial Sequence: Synthetic oligonucleotide
catttcaactgtgagacatgaagtaattttcccaaatctacaacag

SEQ ID NO: 414425 - DNA, 49 bp, Artificial Sequence
  Description of Artificial Sequence: Synthetic oligonucleotide
atttcaactgtgagacatgaagtaattttcccaaatctacaacagtaag

SEQ ID NO: 414426 - DNA, 48 bp, Artificial Sequence
  Description of Artificial Sequence: Synthetic oligonucleotide
tttcaactgtgagacatgaagtaattttcccaaatctacaacagtaag

SEQ ID NO: 414427 - DNA, 47 bp, Artificial Sequence
  Description of Artificial Sequence: Synthetic oligonucleotide
ttcaactgtgagacatgaagtaattttcccaaatctacaacagtaag

SEQ ID NO: 414428 - DNA, 46 bp, Artificial Sequence
  Description of Artificial Sequence: Synthetic oligonucleotide
tcaactgtgagacatgaagtaattttcccaaatctacaacagtaag

SEQ ID NO: 414429 - DNA, 45 bp, Artificial Sequence
  Description of Artificial Sequence: Synthetic oligonucleotide
caactgtgagacatgaagtaattttcccaaatctacaacagtaag

SEQ ID NO: 414430 - DNA, 49 bp, Artificial Sequence
  Description of Artificial Sequence: Synthetic oligonucleotide
aactgtgagacatgaagtaattttcccaaatctacaacagtaagatatg

SEQ ID NO: 414431 - DNA, 48 bp, Artificial Sequence
  Description of Artificial Sequence: Synthetic oligonucleotide
actgtgagacatgaagtaattttcccaaatctacaacagtaagatatg

SEQ ID NO: 414432 - DNA, 47 bp, Artificial Sequence
  Description of Artificial Sequence: Synthetic oligonucleotide
ctgtgagacatgaagtaattttcccaaatctacaacagtaagatatg

SEQ ID NO: 414433 - DNA, 47 bp, Artificial Sequence
  Description of Artificial Sequence: Synthetic oligonucleotide
tgtgagacatgaagtaattttcccaaatctacaacagtaagatatgg

SEQ ID NO: 414434 - DNA, 46 bp, Artificial Sequence
  Description of Artificial Sequence: Synthetic oligonucleotide
gtgagacatgaagtaattttcccaaatctacaacagtaagatatgg

SEQ ID NO: 414435 - DNA, 47 bp, Artificial Sequence
  Description of Artificial Sequence: Synthetic oligonucleotide
tgagacatgaagtaattttcccaaatctacaacagtaagatatggtg

SEQ ID NO: 414436 - DNA, 46 bp, Artificial Sequence
  Description of Artificial Sequence: Synthetic oligonucleotide
gagacatgaagtaattttcccaaatctacaacagtaagatatggtg

SEQ ID NO: 414437 - DNA, 46 bp, Artificial Sequence
  Description of Artificial Sequence: Synthetic oligonucleotide
agacatgaagtaattttcccaaatctacaacagtaagatatggtgc

SEQ ID NO: 414438 - DNA, 45 bp, Artificial Sequence
  Description of Artificial Sequence: Synthetic oligonucleotide
gacatgaagtaattttcccaaatctacaacagtaagatatggtgc

SEQ ID NO: 414439 - DNA, 50 bp, Artificial Sequence
  Description of Artificial Sequence: Synthetic oligonucleotide
acatgaagtaattttcccaaatctacaacagtaagatatggtgcaataag

SEQ ID NO: 414440 - DNA, 49 bp, Artificial Sequence
  Description of Artificial Sequence: Synthetic oligonucleotide
catgaagtaattttcccaaatctacaacagtaagatatggtgcaataag

SEQ ID NO: 414441 - DNA, 49 bp, Artificial Sequence
  Description of Artificial Sequence: Synthetic oligonucleotide
atgaagtaattttcccaaatctacaacagtaagatatggtgcaataagg

SEQ ID NO: 414442 - DNA, 48 bp, Artificial Sequence
  Description of Artificial Sequence: Synthetic oligonucleotide
tgaagtaattttcccaaatctacaacagtaagatatggtgcaataagg

SEQ ID NO: 414443 - DNA, 47 bp, Artificial Sequence
  Description of Artificial Sequence: Synthetic oligonucleotide
gaagtaattttcccaaatctacaacagtaagatatggtgcaataagg

SEQ ID NO: 414444 - DNA, 48 bp, Artificial Sequence
  Description of Artificial Sequence: Synthetic oligonucleotide
aagtaattttcccaaatctacaacagtaagatatggtgcaataaggac

SEQ ID NO: 414445 - DNA, 47 bp, Artificial Sequence
  Description of Artificial Sequence: Synthetic oligonucleotide
agtaattttcccaaatctacaacagtaagatatggtgcaataaggac

SEQ ID NO: 414446 - DNA, 46 bp, Artificial Sequence
  Description of Artificial Sequence: Synthetic oligonucleotide
gtaattttcccaaatctacaacagtaagatatggtgcaataaggac

SEQ ID NO: 414447 - DNA, 46 bp, Artificial Sequence
  Description of Artificial Sequence: Synthetic oligonucleotide
taattttcccaaatctacaacagtaagatatggtgcaataaggacc

SEQ ID NO: 414448 - DNA, 45 bp, Artificial Sequence
  Description of Artificial Sequence: Synthetic oligonucleotide
aattttcccaaatctacaacagtaagatatggtgcaataaggacc

SEQ ID NO: 414449 - DNA, 44 bp, Artificial Sequence
  Description of Artificial Sequence: Synthetic oligonucleotide
attttcccaaatctacaacagtaagatatggtgcaataaggacc

SEQ ID NO: 414450 - DNA, 43 bp, Artificial Sequence
  Description of Artificial Sequence: Synthetic oligonucleotide
ttttcccaaatctacaacagtaagatatggtgcaataaggacc

SEQ ID NO: 414451 - DNA, 42 bp, Artificial Sequence
  Description of Artificial Sequence: Synthetic oligonucleotide
tttcccaaatctacaacagtaagatatggtgcaataaggacc

SEQ ID NO: 414452 - DNA, 41 bp, Artificial Sequence
  Description of Artificial Sequence: Synthetic oligonucleotide
ttcccaaatctacaacagtaagatatggtgcaataaggacc

SEQ ID NO: 414453 - DNA, 40 bp, Artificial Sequence
  Description of Artificial Sequence: Synthetic oligonucleotide
tcccaaatctacaacagtaagatatggtgcaataaggacc

SEQ ID NO: 414454 - DNA, 39 bp, Artificial Sequence
  Description of Artificial Sequence: Synthetic oligonucleotide
cccaaatctacaacagtaagatatggtgcaataaggacc

SEQ ID NO: 414455 - DNA, 40 bp, Artificial Sequence
  Description of Artificial Sequence: Synthetic oligonucleotide
ccaaatctacaacagtaagatatggtgcaataaggaccag

SEQ ID NO: 414456 - DNA, 46 bp, Artificial Sequence
  Description of Artificial Sequence: Synthetic oligonucleotide
caaatctacaacagtaagatatggtgcaataaggaccagattaaag

SEQ ID NO: 414457 - DNA, 46 bp, Artificial Sequence
  Description of Artificial Sequence: Synthetic oligonucleotide
aaatctacaacagtaagatatggtgcaataaggaccagattaaagg

SEQ ID NO: 414458 - DNA, 45 bp, Artificial Sequence
  Description of Artificial Sequence: Synthetic oligonucleotide
aatctacaacagtaagatatggtgcaataaggaccagattaaagg

SEQ ID NO: 414459 - DNA, 44 bp, Artificial Sequence
  Description of Artificial Sequence: Synthetic oligonucleotide
atctacaacagtaagatatggtgcaataaggaccagattaaagg

SEQ ID NO: 414460 - DNA, 43 bp, Artificial Sequence
  Description of Artificial Sequence: Synthetic oligonucleotide
tctacaacagtaagatatggtgcaataaggaccagattaaagg

SEQ ID NO: 414461 - DNA, 42 bp, Artificial Sequence
  Description of Artificial Sequence: Synthetic oligonucleotide
ctacaacagtaagatatggtgcaataaggaccagattaaagg

SEQ ID NO: 414462 - DNA, 43 bp, Artificial Sequence
  Description of Artificial Sequence: Synthetic oligonucleotide
tacaacagtaagatatggtgcaataaggaccagattaaaggtc

SEQ ID NO: 414463 - DNA, 42 bp, Artificial Sequence
  Description of Artificial Sequence: Synthetic oligonucleotide
acaacagtaagatatggtgcaataaggaccagattaaaggtc

SEQ ID NO: 414464 - DNA, 41 bp, Artificial Sequence
  Description of Artificial Sequence: Synthetic oligonucleotide
caacagtaagatatggtgcaataaggaccagattaaaggtc

SEQ ID NO: 414465 - DNA, 41 bp, Artificial Sequence
  Description of Artificial Sequence: Synthetic oligonucleotide
aacagtaagatatggtgcaataaggaccagattaaaggtcc

SEQ ID NO: 414466 - DNA, 40 bp, Artificial Sequence
  Description of Artificial Sequence: Synthetic oligonucleotide
acagtaagatatggtgcaataaggaccagattaaaggtcc

SEQ ID NO: 414467 - DNA, 39 bp, Artificial Sequence
  Description of Artificial Sequence: Synthetic oligonucleotide
cagtaagatatggtgcaataaggaccagattaaaggtcc

SEQ ID NO: 414468 - DNA, 39 bp, Artificial Sequence
  Description of Artificial Sequence: Synthetic oligonucleotide
agtaagatatggtgcaataaggaccagattaaaggtccc

SEQ ID NO: 414469 - DNA, 38 bp, Artificial Sequence
  Description of Artificial Sequence: Synthetic oligonucleotide
gtaagatatggtgcaataaggaccagattaaaggtccc

SEQ ID NO: 414470 - DNA, 38 bp, Artificial Sequence
  Description of Artificial Sequence: Synthetic oligonucleotide
taagatatggtgcaataaggaccagattaaaggtcccc

SEQ ID NO: 414471 - DNA, 37 bp, Artificial Sequence
  Description of Artificial Sequence: Synthetic oligonucleotide
aagatatggtgcaataaggaccagattaaaggtcccc

SEQ ID NO: 414472 - DNA, 36 bp, Artificial Sequence
  Description of Artificial Sequence: Synthetic oligonucleotide
agatatggtgcaataaggaccagattaaaggtcccc

SEQ ID NO: 414473 - DNA, 35 bp, Artificial Sequence
  Description of Artificial Sequence: Synthetic oligonucleotide
gatatggtgcaataaggaccagattaaaggtcccc

SEQ ID NO: 414474 - DNA, 36 bp, Artificial Sequence
  Description of Artificial Sequence: Synthetic oligonucleotide
atatggtgcaataaggaccagattaaaggtcccctg

SEQ ID NO: 414475 - DNA, 35 bp, Artificial Sequence
  Description of Artificial Sequence: Synthetic oligonucleotide
tatggtgcaataaggaccagattaaaggtcccctg

SEQ ID NO: 414476 - DNA, 34 bp, Artificial Sequence
  Description of Artificial Sequence: Synthetic oligonucleotide
atggtgcaataaggaccagattaaaggtcccctg

SEQ ID NO: 414477 - DNA, 33 bp, Artificial Sequence
  Description of Artificial Sequence: Synthetic oligonucleotide
tggtgcaataaggaccagattaaaggtcccctg

SEQ ID NO: 414478 - DNA, 32 bp, Artificial Sequence
  Description of Artificial Sequence: Synthetic oligonucleotide
ggtgcaataaggaccagattaaaggtcccctg

SEQ ID NO: 414479 - DNA, 36 bp, Artificial Sequence
  Description of Artificial Sequence: Synthetic oligonucleotide
gtgcaataaggaccagattaaaggtcccctgatttg

SEQ ID NO: 414480 - DNA, 36 bp, Artificial Sequence
  Description of Artificial Sequence: Synthetic oligonucleotide
tgcaataaggaccagattaaaggtcccctgatttgc

SEQ ID NO: 414481 - DNA, 35 bp, Artificial Sequence
  Description of Artificial Sequence: Synthetic oligonucleotide
gcaataaggaccagattaaaggtcccctgatttgc

SEQ ID NO: 414482 - DNA, 37 bp, Artificial Sequence
  Description of Artificial Sequence: Synthetic oligonucleotide
caataaggaccagattaaaggtcccctgatttgcaac

SEQ ID NO: 414483 - DNA, 37 bp, Artificial Sequence
  Description of Artificial Sequence: Synthetic oligonucleotide
aataaggaccagattaaaggtcccctgatttgcaacc

SEQ ID NO: 414484 - DNA, 36 bp, Artificial Sequence
  Description of Artificial Sequence: Synthetic oligonucleotide
ataaggaccagattaaaggtcccctgatttgcaacc

SEQ ID NO: 414485 - DNA, 35 bp, Artificial Sequence
  Description of Artificial Sequence: Synthetic oligonucleotide
taaggaccagattaaaggtcccctgatttgcaacc

SEQ ID NO: 414486 - DNA, 34 bp, Artificial Sequence
  Description of Artificial Sequence: Synthetic oligonucleotide
aaggaccagattaaaggtcccctgatttgcaacc

SEQ ID NO: 414487 - DNA, 33 bp, Artificial Sequence
  Description of Artificial Sequence: Synthetic oligonucleotide
aggaccagattaaaggtcccctgatttgcaacc

SEQ ID NO: 414488 - DNA, 32 bp, Artificial Sequence
  Description of Artificial Sequence: Synthetic oligonucleotide
ggaccagattaaaggtcccctgatttgcaacc

SEQ ID NO: 414489 - DNA, 34 bp, Artificial Sequence
  Description of Artificial Sequence: Synthetic oligonucleotide
gaccagattaaaggtcccctgatttgcaaccatg

SEQ ID NO: 414490 - DNA, 36 bp, Artificial Sequence
  Description of Artificial Sequence: Synthetic oligonucleotide
accagattaaaggtcccctgatttgcaaccatgttc

SEQ ID NO: 414491 - DNA, 35 bp, Artificial Sequence
  Description of Artificial Sequence: Synthetic oligonucleotide
ccagattaaaggtcccctgatttgcaaccatgttc

SEQ ID NO: 414492 - DNA, 35 bp, Artificial Sequence
  Description of Artificial Sequence: Synthetic oligonucleotide
cagattaaaggtcccctgatttgcaaccatgttcc

SEQ ID NO: 414493 - DNA, 35 bp, Artificial Sequence
  Description of Artificial Sequence: Synthetic oligonucleotide
agattaaaggtcccctgatttgcaaccatgttccc

SEQ ID NO: 414494 - DNA, 34 bp, Artificial Sequence
  Description of Artificial Sequence: Synthetic oligonucleotide
gattaaaggtcccctgatttgcaaccatgttccc

SEQ ID NO: 414495 - DNA, 35 bp, Artificial Sequence
  Description of Artificial Sequence: Synthetic oligonucleotide
attaaaggtcccctgatttgcaaccatgttccctc

SEQ ID NO: 414496 - DNA, 34 bp, Artificial Sequence
  Description of Artificial Sequence: Synthetic oligonucleotide
ttaaaggtcccctgatttgcaaccatgttccctc

SEQ ID NO: 414497 - DNA, 33 bp, Artificial Sequence
  Description of Artificial Sequence: Synthetic oligonucleotide
taaaggtcccctgatttgcaaccatgttccctc

SEQ ID NO: 414498 - DNA, 32 bp, Artificial Sequence
  Description of Artificial Sequence: Synthetic oligonucleotide
aaaggtcccctgatttgcaaccatgttccctc

SEQ ID NO: 414499 - DNA, 31 bp, Artificial Sequence
  Description of Artificial Sequence: Synthetic oligonucleotide
aaggtcccctgatttgcaaccatgttccctc

SEQ ID NO: 414500 - DNA, 30 bp, Artificial Sequence
  Description of Artificial Sequence: Synthetic oligonucleotide
aggtcccctgatttgcaaccatgttccctc

SEQ ID NO: 414501 - DNA, 29 bp, Artificial Sequence
  Description of Artificial Sequence: Synthetic oligonucleotide
ggtcccctgatttgcaaccatgttccctc

SEQ ID NO: 414502 - DNA, 29 bp, Artificial Sequence
  Description of Artificial Sequence: Synthetic oligonucleotide
gtcccctgatttgcaaccatgttccctcc

SEQ ID NO: 414503 - DNA, 31 bp, Artificial Sequence
  Description of Artificial Sequence: Synthetic oligonucleotide
tcccctgatttgcaaccatgttccctccatc

SEQ ID NO: 414504 - DNA, 30 bp, Artificial Sequence
  Description of Artificial Sequence: Synthetic oligonucleotide
cccctgatttgcaaccatgttccctccatc

SEQ ID NO: 414505 - DNA, 31 bp, Artificial Sequence
  Description of Artificial Sequence: Synthetic oligonucleotide
ccctgatttgcaaccatgttccctccatctc

SEQ ID NO: 414506 - DNA, 35 bp, Artificial Sequence
  Description of Artificial Sequence: Synthetic oligonucleotide
caaccatgttccctccatctcctttactcctaaac

SEQ ID NO: 414507 - DNA, 36 bp, Artificial Sequence
  Description of Artificial Sequence: Synthetic oligonucleotide
aaccatgttccctccatctcctttactcctaaacac

SEQ ID NO: 414508 - DNA, 35 bp, Artificial Sequence
  Description of Artificial Sequence: Synthetic oligonucleotide
accatgttccctccatctcctttactcctaaacac

SEQ ID NO: 414509 - DNA, 34 bp, Artificial Sequence
  Description of Artificial Sequence: Synthetic oligonucleotide
ctccatctcctttactcctaaacacactcacacg

SEQ ID NO: 414510 - DNA, 34 bp, Artificial Sequence
  Description of Artificial Sequence: Synthetic oligonucleotide
tccatctcctttactcctaaacacactcacacgc

SEQ ID NO: 414511 - DNA, 33 bp, Artificial Sequence
  Description of Artificial Sequence: Synthetic oligonucleotide
ccatctcctttactcctaaacacactcacacgc

SEQ ID NO: 414512 - DNA, 34 bp, Artificial Sequence
  Description of Artificial Sequence: Synthetic oligonucleotide
catctcctttactcctaaacacactcacacgctc

SEQ ID NO: 414513 - DNA, 35 bp, Artificial Sequence
  Description of Artificial Sequence: Synthetic oligonucleotide
atctcctttactcctaaacacactcacacgctcac

SEQ ID NO: 414514 - DNA, 34 bp, Artificial Sequence
  Description of Artificial Sequence: Synthetic oligonucleotide
tctcctttactcctaaacacactcacacgctcac

SEQ ID NO: 414515 - DNA, 33 bp, Artificial Sequence
  Description of Artificial Sequence: Synthetic oligonucleotide
ctcctttactcctaaacacactcacacgctcac

SEQ ID NO: 414516 - DNA, 34 bp, Artificial Sequence
  Description of Artificial Sequence: Synthetic oligonucleotide
tcctttactcctaaacacactcacacgctcactc

SEQ ID NO: 414517 - DNA, 33 bp, Artificial Sequence
  Description of Artificial Sequence: Synthetic oligonucleotide
cctttactcctaaacacactcacacgctcactc

SEQ ID NO: 414518 - DNA, 33 bp, Artificial Sequence
  Description of Artificial Sequence: Synthetic oligonucleotide
ctttactcctaaacacactcacacgctcactcc

SEQ ID NO: 414519 - DNA, 34 bp, Artificial Sequence
  Description of Artificial Sequence: Synthetic oligonucleotide
tttactcctaaacacactcacacgctcactcctg

SEQ ID NO: 414520 - DNA, 33 bp, Artificial Sequence
  Description of Artificial Sequence: Synthetic oligonucleotide
ttactcctaaacacactcacacgctcactcctg

SEQ ID NO: 414521 - DNA, 32 bp, Artificial Sequence
  Description of Artificial Sequence: Synthetic oligonucleotide
tactcctaaacacactcacacgctcactcctg

SEQ ID NO: 414522 - DNA, 31 bp, Artificial Sequence
  Description of Artificial Sequence: Synthetic oligonucleotide
actcctaaacacactcacacgctcactcctg

SEQ ID NO: 414523 - DNA, 30 bp, Artificial Sequence
  Description of Artificial Sequence: Synthetic oligonucleotide
ctcctaaacacactcacacgctcactcctg

SEQ ID NO: 414524 - DNA, 30 bp, Artificial Sequence
  Description of Artificial Sequence: Synthetic oligonucleotide
tcctaaacacactcacacgctcactcctgc

SEQ ID NO: 414525 - DNA, 29 bp, Artificial Sequence
  Description of Artificial Sequence: Synthetic oligonucleotide
cctaaacacactcacacgctcactcctgc

SEQ ID NO: 414526 - DNA, 32 bp, Artificial Sequence
  Description of Artificial Sequence: Synthetic oligonucleotide
ctaaacacactcacacgctcactcctgcaaac

SEQ ID NO: 414527 - DNA, 33 bp, Artificial Sequence
  Description of Artificial Sequence: Synthetic oligonucleotide
taaacacactcacacgctcactcctgcaaacag

SEQ ID NO: 414528 - DNA, 32 bp, Artificial Sequence
  Description of Artificial Sequence: Synthetic oligonucleotide
aaacacactcacacgctcactcctgcaaacag

SEQ ID NO: 414529 - DNA, 31 bp, Artificial Sequence
  Description of Artificial Sequence: Synthetic oligonucleotide
aacacactcacacgctcactcctgcaaacag

SEQ ID NO: 414530 - DNA, 30 bp, Artificial Sequence
  Description of Artificial Sequence: Synthetic oligonucleotide
acacactcacacgctcactcctgcaaacag

SEQ ID NO: 414531 - DNA, 29 bp, Artificial Sequence
  Description of Artificial Sequence: Synthetic oligonucleotide
cacactcacacgctcactcctgcaaacag

SEQ ID NO: 414532 - DNA, 31 bp, Artificial Sequence
  Description of Artificial Sequence: Synthetic oligonucleotide
acactcacacgctcactcctgcaaacagttg

SEQ ID NO: 414533 - DNA, 30 bp, Artificial Sequence
  Description of Artificial Sequence: Synthetic oligonucleotide
cactcacacgctcactcctgcaaacagttg

SEQ ID NO: 414534 - DNA, 31 bp, Artificial Sequence
  Description of Artificial Sequence: Synthetic oligonucleotide
actcacacgctcactcctgcaaacagttgtc

SEQ ID NO: 414535 - DNA, 30 bp, Artificial Sequence
  Description of Artificial Sequence: Synthetic oligonucleotide
ctcacacgctcactcctgcaaacagttgtc

SEQ ID NO: 414536 - DNA, 32 bp, Artificial Sequence
  Description of Artificial Sequence: Synthetic oligonucleotide
tcacacgctcactcctgcaaacagttgtcttg

SEQ ID NO: 414537 - DNA, 31 bp, Artificial Sequence
  Description of Artificial Sequence: Synthetic oligonucleotide
cacacgctcactcctgcaaacagttgtcttg

SEQ ID NO: 414538 - DNA, 32 bp, Artificial Sequence
  Description of Artificial Sequence: Synthetic oligonucleotide
acacgctcactcctgcaaacagttgtcttgtc

SEQ ID NO: 414539 - DNA, 31 bp, Artificial Sequence
  Description of Artificial Sequence: Synthetic oligonucleotide
cacgctcactcctgcaaacagttgtcttgtc

SEQ ID NO: 414540 - DNA, 33 bp, Artificial Sequence
  Description of Artificial Sequence: Synthetic oligonucleotide
acgctcactcctgcaaacagttgtcttgtcaag

SEQ ID NO: 414541 - DNA, 32 bp, Artificial Sequence
  Description of Artificial Sequence: Synthetic oligonucleotide
cgctcactcctgcaaacagttgtcttgtcaag

SEQ ID NO: 414542 - DNA, 33 bp, Artificial Sequence
  Description of Artificial Sequence: Synthetic oligonucleotide
gctcactcctgcaaacagttgtcttgtcaagtg

SEQ ID NO: 414543 - DNA, 33 bp, Artificial Sequence
  Description of Artificial Sequence: Synthetic oligonucleotide
ctcactcctgcaaacagttgtcttgtcaagtgg

SEQ ID NO: 414544 - DNA, 33 bp, Artificial Sequence
  Description of Artificial Sequence: Synthetic oligonucleotide
tcactcctgcaaacagttgtcttgtcaagtggg

SEQ ID NO: 414545 - DNA, 32 bp, Artificial Sequence
  Description of Artificial Sequence: Synthetic oligonucleotide
cactcctgcaaacagttgtcttgtcaagtggg

SEQ ID NO: 414546 - DNA, 36 bp, Artificial Sequence
  Description of Artificial Sequence: Synthetic oligonucleotide
actcctgcaaacagttgtcttgtcaagtgggaaatg

SEQ ID NO: 414547 - DNA, 35 bp, Artificial Sequence
  Description of Artificial Sequence: Synthetic oligonucleotide
ctcctgcaaacagttgtcttgtcaagtgggaaatg

SEQ ID NO: 414548 - DNA, 38 bp, Artificial Sequence
  Description of Artificial Sequence: Synthetic oligonucleotide
tcctgcaaacagttgtcttgtcaagtgggaaatgaatg

SEQ ID NO: 414549 - DNA, 37 bp, Artificial Sequence
  Description of Artificial Sequence: Synthetic oligonucleotide
cctgcaaacagttgtcttgtcaagtgggaaatgaatg

SEQ ID NO: 414550 - DNA, 37 bp, Artificial Sequence
  Description of Artificial Sequence: Synthetic oligonucleotide
ctgcaaacagttgtcttgtcaagtgggaaatgaatgc

SEQ ID NO: 414551 - DNA, 38 bp, Artificial Sequence
  Description of Artificial Sequence: Synthetic oligonucleotide
tgcaaacagttgtcttgtcaagtgggaaatgaatgctc

SEQ ID NO: 414552 - DNA, 37 bp, Artificial Sequence
  Description of Artificial Sequence: Synthetic oligonucleotide
gcaaacagttgtcttgtcaagtgggaaatgaatgctc

SEQ ID NO: 414553 - DNA, 39 bp, Artificial Sequence
  Description of Artificial Sequence: Synthetic oligonucleotide
caaacagttgtcttgtcaagtgggaaatgaatgctcttg

SEQ ID NO: 414554 - DNA, 39 bp, Artificial Sequence
  Description of Artificial Sequence: Synthetic oligonucleotide
aaacagttgtcttgtcaagtgggaaatgaatgctcttgc

SEQ ID NO: 414555 - DNA, 38 bp, Artificial Sequence
  Description of Artificial Sequence: Synthetic oligonucleotide
aacagttgtcttgtcaagtgggaaatgaatgctcttgc

SEQ ID NO: 414556 - DNA, 37 bp, Artificial Sequence
  Description of Artificial Sequence: Synthetic oligonucleotide
acagttgtcttgtcaagtgggaaatgaatgctcttgc

SEQ ID NO: 414557 - DNA, 36 bp, Artificial Sequence
  Description of Artificial Sequence: Synthetic oligonucleotide
cagttgtcttgtcaagtgggaaatgaatgctcttgc

SEQ ID NO: 414558 - DNA, 38 bp, Artificial Sequence
  Description of Artificial Sequence: Synthetic oligonucleotide
agttgtcttgtcaagtgggaaatgaatgctcttgcaag

SEQ ID NO: 414559 - DNA, 37 bp, Artificial Sequence
  Description of Artificial Sequence: Synthetic oligonucleotide
gttgtcttgtcaagtgggaaatgaatgctcttgcaag

SEQ ID NO: 414560 - DNA, 37 bp, Artificial Sequence
  Description of Artificial Sequence: Synthetic oligonucleotide
ttgtcttgtcaagtgggaaatgaatgctcttgcaagg

SEQ ID NO: 414561 - DNA, 36 bp, Artificial Sequence
  Description of Artificial Sequence: Synthetic oligonucleotide
tgtcttgtcaagtgggaaatgaatgctcttgcaagg

SEQ ID NO: 414562 - DNA, 35 bp, Artificial Sequence
  Description of Artificial Sequence: Synthetic oligonucleotide
gtcttgtcaagtgggaaatgaatgctcttgcaagg

SEQ ID NO: 414563 - DNA, 35 bp, Artificial Sequence
  Description of Artificial Sequence: Synthetic oligonucleotide
tcttgtcaagtgggaaatgaatgctcttgcaaggc

SEQ ID NO: 414564 - DNA, 34 bp, Artificial Sequence
  Description of Artificial Sequence: Synthetic oligonucleotide
cttgtcaagtgggaaatgaatgctcttgcaaggc

SEQ ID NO: 414565 - DNA, 35 bp, Artificial Sequence
  Description of Artificial Sequence: Synthetic oligonucleotide
ttgtcaagtgggaaatgaatgctcttgcaaggctc

SEQ ID NO: 414566 - DNA, 34 bp, Artificial Sequence
  Description of Artificial Sequence: Synthetic oligonucleotide
tgtcaagtgggaaatgaatgctcttgcaaggctc

SEQ ID NO: 414567 - DNA, 33 bp, Artificial Sequence
  Description of Artificial Sequence: Synthetic oligonucleotide
gtcaagtgggaaatgaatgctcttgcaaggctc

SEQ ID NO: 414568 - DNA, 36 bp, Artificial Sequence
  Description of Artificial Sequence: Synthetic oligonucleotide
tcaagtgggaaatgaatgctcttgcaaggctcaaac

SEQ ID NO: 414569 - DNA, 35 bp, Artificial Sequence
  Description of Artificial Sequence: Synthetic oligonucleotide
caagtgggaaatgaatgctcttgcaaggctcaaac

SEQ ID NO: 414570 - DNA, 37 bp, Artificial Sequence
  Description of Artificial Sequence: Synthetic oligonucleotide
aagtgggaaatgaatgctcttgcaaggctcaaacttg

SEQ ID NO: 414571 - DNA, 36 bp, Artificial Sequence
  Description of Artificial Sequence: Synthetic oligonucleotide
agtgggaaatgaatgctcttgcaaggctcaaacttg

SEQ ID NO: 414572 - DNA, 35 bp, Artificial Sequence
  Description of Artificial Sequence: Synthetic oligonucleotide
gtgggaaatgaatgctcttgcaaggctcaaacttg

SEQ ID NO: 414573 - DNA, 36 bp, Artificial Sequence
  Description of Artificial Sequence: Synthetic oligonucleotide
tgggaaatgaatgctcttgcaaggctcaaacttgtg

SEQ ID NO: 414574 - DNA, 35 bp, Artificial Sequence
  Description of Artificial Sequence: Synthetic oligonucleotide
gggaaatgaatgctcttgcaaggctcaaacttgtg

SEQ ID NO: 414575 - DNA, 37 bp, Artificial Sequence
  Description of Artificial Sequence: Synthetic oligonucleotide
ggaaatgaatgctcttgcaaggctcaaacttgtgaac

SEQ ID NO: 414576 - DNA, 38 bp, Artificial Sequence
  Description of Artificial Sequence: Synthetic oligonucleotide
gaaatgaatgctcttgcaaggctcaaacttgtgaacac

SEQ ID NO: 414577 - DNA, 40 bp, Artificial Sequence
  Description of Artificial Sequence: Synthetic oligonucleotide
aaatgaatgctcttgcaaggctcaaacttgtgaacacatc

SEQ ID NO: 414578 - DNA, 39 bp, Artificial Sequence
  Description of Artificial Sequence: Synthetic oligonucleotide
aatgaatgctcttgcaaggctcaaacttgtgaacacatc

SEQ ID NO: 414579 - DNA, 38 bp, Artificial Sequence
  Description of Artificial Sequence: Synthetic oligonucleotide
atgaatgctcttgcaaggctcaaacttgtgaacacatc

SEQ ID NO: 414580 - DNA, 37 bp, Artificial Sequence
  Description of Artificial Sequence: Synthetic oligonucleotide
tgaatgctcttgcaaggctcaaacttgtgaacacatc

SEQ ID NO: 414581 - DNA, 36 bp, Artificial Sequence
  Description of Artificial Sequence: Synthetic oligonucleotide
gaatgctcttgcaaggctcaaacttgtgaacacatc

SEQ ID NO: 414582 - DNA, 37 bp, Artificial Sequence
  Description of Artificial Sequence: Synthetic oligonucleotide
aatgctcttgcaaggctcaaacttgtgaacacatcac

SEQ ID NO: 414583 - DNA, 36 bp, Artificial Sequence
  Description of Artificial Sequence: Synthetic oligonucleotide
atgctcttgcaaggctcaaacttgtgaacacatcac

SEQ ID NO: 414584 - DNA, 35 bp, Artificial Sequence
  Description of Artificial Sequence: Synthetic oligonucleotide
tgctcttgcaaggctcaaacttgtgaacacatcac

SEQ ID NO: 414585 - DNA, 34 bp, Artificial Sequence
  Description of Artificial Sequence: Synthetic oligonucleotide
gctcttgcaaggctcaaacttgtgaacacatcac

SEQ ID NO: 414586 - DNA, 35 bp, Artificial Sequence
  Description of Artificial Sequence: Synthetic oligonucleotide
ctcttgcaaggctcaaacttgtgaacacatcactg

SEQ ID NO: 414587 - DNA, 36 bp, Artificial Sequence
  Description of Artificial Sequence: Synthetic oligonucleotide
tcttgcaaggctcaaacttgtgaacacatcactgac

SEQ ID NO: 414588 - DNA, 35 bp, Artificial Sequence
  Description of Artificial Sequence: Synthetic oligonucleotide
cttgcaaggctcaaacttgtgaacacatcactgac

SEQ ID NO: 414589 - DNA, 35 bp, Artificial Sequence
  Description of Artificial Sequence: Synthetic oligonucleotide
ttgcaaggctcaaacttgtgaacacatcactgacc

SEQ ID NO: 414590 - DNA, 34 bp, Artificial Sequence
  Description of Artificial Sequence: Synthetic oligonucleotide
tgcaaggctcaaacttgtgaacacatcactgacc

SEQ ID NO: 414591 - DNA, 33 bp, Artificial Sequence
  Description of Artificial Sequence: Synthetic oligonucleotide
gcaaggctcaaacttgtgaacacatcactgacc

SEQ ID NO: 414592 - DNA, 28 bp, Artificial Sequence
  Description of Artificial Sequence: Synthetic oligonucleotide
acatcactgaccagcacagagctggctc

SEQ ID NO: 414593 - DNA, 27 bp, Artificial Sequence
  Description of Artificial Sequence: Synthetic oligonucleotide
catcactgaccagcacagagctggctc

SEQ ID NO: 414594 - DNA, 28 bp, Artificial Sequence
  Description of Artificial Sequence: Synthetic oligonucleotide
atcactgaccagcacagagctggctcac

SEQ ID NO: 414595 - DNA, 27 bp, Artificial Sequence
  Description of Artificial Sequence: Synthetic oligonucleotide
tcactgaccagcacagagctggctcac

SEQ ID NO: 414596 - DNA, 27 bp, Artificial Sequence
  Description of Artificial Sequence: Synthetic oligonucleotide
cactgaccagcacagagctggctcaca

SEQ ID NO: 414597 - DNA, 30 bp, Artificial Sequence
  Description of Artificial Sequence: Synthetic oligonucleotide
actgaccagcacagagctggctcacaatag

SEQ ID NO: 414598 - DNA, 29 bp, Artificial Sequence
  Description of Artificial Sequence: Synthetic oligonucleotide
ctgaccagcacagagctggctcacaatag

SEQ ID NO: 414599 - DNA, 29 bp, Artificial Sequence
  Description of Artificial Sequence: Synthetic oligonucleotide
tgaccagcacagagctggctcacaatagg

SEQ ID NO: 414600 - DNA, 28 bp, Artificial Sequence
  Description of Artificial Sequence: Synthetic oligonucleotide
gaccagcacagagctggctcacaatagg

SEQ ID NO: 414601 - DNA, 28 bp, Artificial Sequence
  Description of Artificial Sequence: Synthetic oligonucleotide
accagcacagagctggctcacaataggg

SEQ ID NO: 414602 - DNA, 27 bp, Artificial Sequence
  Description of Artificial Sequence: Synthetic oligonucleotide
ccagcacagagctggctcacaataggg

SEQ ID NO: 414603 - DNA, 28 bp, Artificial Sequence
  Description of Artificial Sequence: Synthetic oligonucleotide
cagcacagagctggctcacaatagggac

SEQ ID NO: 414604 - DNA, 28 bp, Artificial Sequence
  Description of Artificial Sequence: Synthetic oligonucleotide
agcacagagctggctcacaatagggacg

SEQ ID NO: 414605 - DNA, 27 bp, Artificial Sequence
  Description of Artificial Sequence: Synthetic oligonucleotide
gcacagagctggctcacaatagggacg

SEQ ID NO: 414606 - DNA, 27 bp, Artificial Sequence
  Description of Artificial Sequence: Synthetic oligonucleotide
cacagagctggctcacaatagggacgc

SEQ ID NO: 414607 - DNA, 34 bp, Artificial Sequence
  Description of Artificial Sequence: Synthetic oligonucleotide
acagagctggctcacaatagggacgcaattaaag

SEQ ID NO: 414608 - DNA, 33 bp, Artificial Sequence
  Description of Artificial Sequence: Synthetic oligonucleotide
cagagctggctcacaatagggacgcaattaaag

SEQ ID NO: 414609 - DNA, 34 bp, Artificial Sequence
  Description of Artificial Sequence: Synthetic oligonucleotide
agagctggctcacaatagggacgcaattaaagtg

SEQ ID NO: 414610 - DNA, 33 bp, Artificial Sequence
  Description of Artificial Sequence: Synthetic oligonucleotide
gagctggctcacaatagggacgcaattaaagtg

SEQ ID NO: 414611 - DNA, 38 bp, Artificial Sequence
  Description of Artificial Sequence: Synthetic oligonucleotide
agctggctcacaatagggacgcaattaaagtgttttac

SEQ ID NO: 414612 - DNA, 37 bp, Artificial Sequence
  Description of Artificial Sequence: Synthetic oligonucleotide
gctggctcacaatagggacgcaattaaagtgttttac

SEQ ID NO: 414613 - DNA, 38 bp, Artificial Sequence
  Description of Artificial Sequence: Synthetic oligonucleotide
ctggctcacaatagggacgcaattaaagtgttttacac

SEQ ID NO: 414614 - DNA, 38 bp, Artificial Sequence
  Description of Artificial Sequence: Synthetic oligonucleotide
tggctcacaatagggacgcaattaaagtgttttacacg

SEQ ID NO: 414615 - DNA, 37 bp, Artificial Sequence
  Description of Artificial Sequence: Synthetic oligonucleotide
ggctcacaatagggacgcaattaaagtgttttacacg

SEQ ID NO: 414616 - DNA, 37 bp, Artificial Sequence
  Description of Artificial Sequence: Synthetic oligonucleotide
gctcacaatagggacgcaattaaagtgttttacacgc

SEQ ID NO: 414617 - DNA, 39 bp, Artificial Sequence
  Description of Artificial Sequence: Synthetic oligonucleotide
ctcacaatagggacgcaattaaagtgttttacacgcaac

SEQ ID NO: 414618 - DNA, 40 bp, Artificial Sequence
  Description of Artificial Sequence: Synthetic oligonucleotide
tcacaatagggacgcaattaaagtgttttacacgcaactg

SEQ ID NO: 414619 - DNA, 39 bp, Artificial Sequence
  Description of Artificial Sequence: Synthetic oligonucleotide
cacaatagggacgcaattaaagtgttttacacgcaactg

SEQ ID NO: 414620 - DNA, 39 bp, Artificial Sequence
  Description of Artificial Sequence: Synthetic oligonucleotide
acaatagggacgcaattaaagtgttttacacgcaactgg

SEQ ID NO: 414621 - DNA, 38 bp, Artificial Sequence
  Description of Artificial Sequence: Synthetic oligonucleotide
caatagggacgcaattaaagtgttttacacgcaactgg

SEQ ID NO: 414622 - DNA, 40 bp, Artificial Sequence
  Description of Artificial Sequence: Synthetic oligonucleotide
aatagggacgcaattaaagtgttttacacgcaactggttc

SEQ ID NO: 414623 - DNA, 39 bp, Artificial Sequence
  Description of Artificial Sequence: Synthetic oligonucleotide
atagggacgcaattaaagtgttttacacgcaactggttc

SEQ ID NO: 414624 - DNA, 38 bp, Artificial Sequence
  Description of Artificial Sequence: Synthetic oligonucleotide
tagggacgcaattaaagtgttttacacgcaactggttc

SEQ ID NO: 414625 - DNA, 37 bp, Artificial Sequence
  Description of Artificial Sequence: Synthetic oligonucleotide
agggacgcaattaaagtgttttacacgcaactggttc

SEQ ID NO: 414626 - DNA, 36 bp, Artificial Sequence
  Description of Artificial Sequence: Synthetic oligonucleotide
gggacgcaattaaagtgttttacacgcaactggttc

SEQ ID NO: 414627 - DNA, 39 bp, Artificial Sequence
  Description of Artificial Sequence: Synthetic oligonucleotide
ggacgcaattaaagtgttttacacgcaactggttcaaac

SEQ ID NO: 414628 - DNA, 39 bp, Artificial Sequence
  Description of Artificial Sequence: Synthetic oligonucleotide
gacgcaattaaagtgttttacacgcaactggttcaaacc

SEQ ID NO: 414629 - DNA, 42 bp, Artificial Sequence
  Description of Artificial Sequence: Synthetic oligonucleotide
acgcaattaaagtgttttacacgcaactggttcaaacctttc

SEQ ID NO: 414630 - DNA, 41 bp, Artificial Sequence
  Description of Artificial Sequence: Synthetic oligonucleotide
cgcaattaaagtgttttacacgcaactggttcaaacctttc

SEQ ID NO: 414631 - DNA, 43 bp, Artificial Sequence
  Description of Artificial Sequence: Synthetic oligonucleotide
gcaattaaagtgttttacacgcaactggttcaaacctttcaag

SEQ ID NO: 414632 - DNA, 45 bp, Artificial Sequence
  Description of Artificial Sequence: Synthetic oligonucleotide
caattaaagtgttttacacgcaactggttcaaacctttcaagtac

SEQ ID NO: 414633 - DNA, 55 bp, Artificial Sequence
  Description of Artificial Sequence: Synthetic oligonucleotide
aattaaagtgttttacacgcaactggttcaaacctttcaagtactaaattaaaac

SEQ ID NO: 414634 - DNA, 54 bp, Artificial Sequence
  Description of Artificial Sequence: Synthetic oligonucleotide
attaaagtgttttacacgcaactggttcaaacctttcaagtactaaattaaaac

SEQ ID NO: 414635 - DNA, 53 bp, Artificial Sequence
  Description of Artificial Sequence: Synthetic oligonucleotide
ttaaagtgttttacacgcaactggttcaaacctttcaagtactaaattaaaac

SEQ ID NO: 414636 - DNA, 52 bp, Artificial Sequence
  Description of Artificial Sequence: Synthetic oligonucleotide
taaagtgttttacacgcaactggttcaaacctttcaagtactaaattaaaac

SEQ ID NO: 414637 - DNA, 51 bp, Artificial Sequence
  Description of Artificial Sequence: Synthetic oligonucleotide
aaagtgttttacacgcaactggttcaaacctttcaagtactaaattaaaac

SEQ ID NO: 414638 - DNA, 50 bp, Artificial Sequence
  Description of Artificial Sequence: Synthetic oligonucleotide
aagtgttttacacgcaactggttcaaacctttcaagtactaaattaaaac

SEQ ID NO: 414639 - DNA, 49 bp, Artificial Sequence
  Description of Artificial Sequence: Synthetic oligonucleotide
agtgttttacacgcaactggttcaaacctttcaagtactaaattaaaac

SEQ ID NO: 414640 - DNA, 50 bp, Artificial Sequence
  Description of Artificial Sequence: Synthetic oligonucleotide
gcaactggttcaaacctttcaagtactaaattaaaacaatcctttaaagg

SEQ ID NO: 414641 - DNA, 51 bp, Artificial Sequence
  Description of Artificial Sequence: Synthetic oligonucleotide
caactggttcaaacctttcaagtactaaattaaaacaatcctttaaaggag

SEQ ID NO: 414642 - DNA, 51 bp, Artificial Sequence
  Description of Artificial Sequence: Synthetic oligonucleotide
aactggttcaaacctttcaagtactaaattaaaacaatcctttaaaggagg

SEQ ID NO: 414643 - DNA, 50 bp, Artificial Sequence
  Description of Artificial Sequence: Synthetic oligonucleotide
actggttcaaacctttcaagtactaaattaaaacaatcctttaaaggagg

SEQ ID NO: 414644 - DNA, 49 bp, Artificial Sequence
  Description of Artificial Sequence: Synthetic oligonucleotide
ctggttcaaacctttcaagtactaaattaaaacaatcctttaaaggagg

SEQ ID NO: 414645 - DNA, 54 bp, Artificial Sequence
  Description of Artificial Sequence: Synthetic oligonucleotide
tggttcaaacctttcaagtactaaattaaaacaatcctttaaaggaggaaattg

SEQ ID NO: 414646 - DNA, 53 bp, Artificial Sequence
  Description of Artificial Sequence: Synthetic oligonucleotide
ggttcaaacctttcaagtactaaattaaaacaatcctttaaaggaggaaattg

SEQ ID NO: 414647 - DNA, 56 bp, Artificial Sequence
  Description of Artificial Sequence: Synthetic oligonucleotide
gttcaaacctttcaagtactaaattaaaacaatcctttaaaggaggaaattgtttc

SEQ ID NO: 414648 - DNA, 57 bp, Artificial Sequence
  Description of Artificial Sequence: Synthetic oligonucleotide
ttcaaacctttcaagtactaaattaaaacaatcctttaaaggaggaaattgtttcag

SEQ ID NO: 414649 - DNA, 56 bp, Artificial Sequence
  Description of Artificial Sequence: Synthetic oligonucleotide
tcaaacctttcaagtactaaattaaaacaatcctttaaaggaggaaattgtttcag

SEQ ID NO: 414650 - DNA, 55 bp, Artificial Sequence
  Description of Artificial Sequence: Synthetic oligonucleotide
caaacctttcaagtactaaattaaaacaatcctttaaaggaggaaattgtttcag

SEQ ID NO: 414651 - DNA, 57 bp, Artificial Sequence
  Description of Artificial Sequence: Synthetic oligonucleotide
aaacctttcaagtactaaattaaaacaatcctttaaaggaggaaattgtttcagaag

SEQ ID NO: 414652 - DNA, 56 bp, Artificial Sequence
  Description of Artificial Sequence: Synthetic oligonucleotide
aacctttcaagtactaaattaaaacaatcctttaaaggaggaaattgtttcagaag

SEQ ID NO: 414653 - DNA, 55 bp, Artificial Sequence
  Description of Artificial Sequence: Synthetic oligonucleotide
acctttcaagtactaaattaaaacaatcctttaaaggaggaaattgtttcagaag

SEQ ID NO: 414654 - DNA, 54 bp, Artificial Sequence
  Description of Artificial Sequence: Synthetic oligonucleotide
cctttcaagtactaaattaaaacaatcctttaaaggaggaaattgtttcagaag

SEQ ID NO: 414655 - DNA, 55 bp, Artificial Sequence
  Description of Artificial Sequence: Synthetic oligonucleotide
ctttcaagtactaaattaaaacaatcctttaaaggaggaaattgtttcagaagag

SEQ ID NO: 414656 - DNA, 55 bp, Artificial Sequence
  Description of Artificial Sequence: Synthetic oligonucleotide
tttcaagtactaaattaaaacaatcctttaaaggaggaaattgtttcagaagagg

SEQ ID NO: 414657 - DNA, 54 bp, Artificial Sequence
  Description of Artificial Sequence: Synthetic oligonucleotide
ttcaagtactaaattaaaacaatcctttaaaggaggaaattgtttcagaagagg

SEQ ID NO: 414658 - DNA, 53 bp, Artificial Sequence
  Description of Artificial Sequence: Synthetic oligonucleotide
tcaagtactaaattaaaacaatcctttaaaggaggaaattgtttcagaagagg

SEQ ID NO: 414659 - DNA, 52 bp, Artificial Sequence
  Description of Artificial Sequence: Synthetic oligonucleotide
caagtactaaattaaaacaatcctttaaaggaggaaattgtttcagaagagg

SEQ ID NO: 414660 - DNA, 53 bp, Artificial Sequence
  Description of Artificial Sequence: Synthetic oligonucleotide
aagtactaaattaaaacaatcctttaaaggaggaaattgtttcagaagaggac

SEQ ID NO: 414661 - DNA, 52 bp, Artificial Sequence
  Description of Artificial Sequence: Synthetic oligonucleotide
agtactaaattaaaacaatcctttaaaggaggaaattgtttcagaagaggac

SEQ ID NO: 414662 - DNA, 51 bp, Artificial Sequence
  Description of Artificial Sequence: Synthetic oligonucleotide
gtactaaattaaaacaatcctttaaaggaggaaattgtttcagaagaggac

SEQ ID NO: 414663 - DNA, 51 bp, Artificial Sequence
  Description of Artificial Sequence: Synthetic oligonucleotide
tactaaattaaaacaatcctttaaaggaggaaattgtttcagaagaggacc

SEQ ID NO: 414664 - DNA, 50 bp, Artificial Sequence
  Description of Artificial Sequence: Synthetic oligonucleotide
actaaattaaaacaatcctttaaaggaggaaattgtttcagaagaggacc

SEQ ID NO: 414665 - DNA, 49 bp, Artificial Sequence
  Description of Artificial Sequence: Synthetic oligonucleotide
ctaaattaaaacaatcctttaaaggaggaaattgtttcagaagaggacc

SEQ ID NO: 414666 - DNA, 51 bp, Artificial Sequence
  Description of Artificial Sequence: Synthetic oligonucleotide
taaattaaaacaatcctttaaaggaggaaattgtttcagaagaggaccttc

SEQ ID NO: 414667 - DNA, 50 bp, Artificial Sequence
  Description of Artificial Sequence: Synthetic oligonucleotide
aaattaaaacaatcctttaaaggaggaaattgtttcagaagaggaccttc

SEQ ID NO: 414668 - DNA, 49 bp, Artificial Sequence
  Description of Artificial Sequence: Synthetic oligonucleotide
aattaaaacaatcctttaaaggaggaaattgtttcagaagaggaccttc

SEQ ID NO: 414669 - DNA, 48 bp, Artificial Sequence
  Description of Artificial Sequence: Synthetic oligonucleotide
attaaaacaatcctttaaaggaggaaattgtttcagaagaggaccttc

SEQ ID NO: 414670 - DNA, 47 bp, Artificial Sequence
  Description of Artificial Sequence: Synthetic oligonucleotide
ttaaaacaatcctttaaaggaggaaattgtttcagaagaggaccttc

SEQ ID NO: 414671 - DNA, 46 bp, Artificial Sequence
  Description of Artificial Sequence: Synthetic oligonucleotide
taaaacaatcctttaaaggaggaaattgtttcagaagaggaccttc

SEQ ID NO: 414672 - DNA, 45 bp, Artificial Sequence
  Description of Artificial Sequence: Synthetic oligonucleotide
aaaacaatcctttaaaggaggaaattgtttcagaagaggaccttc

SEQ ID NO: 414673 - DNA, 44 bp, Artificial Sequence
  Description of Artificial Sequence: Synthetic oligonucleotide
aaacaatcctttaaaggaggaaattgtttcagaagaggaccttc

SEQ ID NO: 414674 - DNA, 43 bp, Artificial Sequence
  Description of Artificial Sequence: Synthetic oligonucleotide
aacaatcctttaaaggaggaaattgtttcagaagaggaccttc

SEQ ID NO: 414675 - DNA, 42 bp, Artificial Sequence
  Description of Artificial Sequence: Synthetic oligonucleotide
acaatcctttaaaggaggaaattgtttcagaagaggaccttc

SEQ ID NO: 414676 - DNA, 41 bp, Artificial Sequence
  Description of Artificial Sequence: Synthetic oligonucleotide
caatcctttaaaggaggaaattgtttcagaagaggaccttc

SEQ ID NO: 414677 - DNA, 44 bp, Artificial Sequence
  Description of Artificial Sequence: Synthetic oligonucleotide
aatcctttaaaggaggaaattgtttcagaagaggaccttcatac

SEQ ID NO: 414678 - DNA, 43 bp, Artificial Sequence
  Description of Artificial Sequence: Synthetic oligonucleotide
atcctttaaaggaggaaattgtttcagaagaggaccttcatac

SEQ ID NO: 414679 - DNA, 42 bp, Artificial Sequence
  Description of Artificial Sequence: Synthetic oligonucleotide
tcctttaaaggaggaaattgtttcagaagaggaccttcatac

SEQ ID NO: 414680 - DNA, 41 bp, Artificial Sequence
  Description of Artificial Sequence: Synthetic oligonucleotide
cctttaaaggaggaaattgtttcagaagaggaccttcatac

SEQ ID NO: 414681 - DNA, 42 bp, Artificial Sequence
  Description of Artificial Sequence: Synthetic oligonucleotide
ctttaaaggaggaaattgtttcagaagaggaccttcatacag

SEQ ID NO: 414682 - DNA, 42 bp, Artificial Sequence
  Description of Artificial Sequence: Synthetic oligonucleotide
tttaaaggaggaaattgtttcagaagaggaccttcatacagc

SEQ ID NO: 414683 - DNA, 41 bp, Artificial Sequence
  Description of Artificial Sequence: Synthetic oligonucleotide
ttaaaggaggaaattgtttcagaagaggaccttcatacagc

SEQ ID NO: 414684 - DNA, 40 bp, Artificial Sequence
  Description of Artificial Sequence: Synthetic oligonucleotide
taaaggaggaaattgtttcagaagaggaccttcatacagc

SEQ ID NO: 414685 - DNA, 39 bp, Artificial Sequence
  Description of Artificial Sequence: Synthetic oligonucleotide
aaaggaggaaattgtttcagaagaggaccttcatacagc

SEQ ID NO: 414686 - DNA, 38 bp, Artificial Sequence
  Description of Artificial Sequence: Synthetic oligonucleotide
aaggaggaaattgtttcagaagaggaccttcatacagc

SEQ ID NO: 414687 - DNA, 37 bp, Artificial Sequence
  Description of Artificial Sequence: Synthetic oligonucleotide
aggaggaaattgtttcagaagaggaccttcatacagc

SEQ ID NO: 414688 - DNA, 36 bp, Artificial Sequence
  Description of Artificial Sequence: Synthetic oligonucleotide
ggaggaaattgtttcagaagaggaccttcatacagc

SEQ ID NO: 414689 - DNA, 38 bp, Artificial Sequence
  Description of Artificial Sequence: Synthetic oligonucleotide
gaggaaattgtttcagaagaggaccttcatacagcatc

SEQ ID NO: 414690 - DNA, 39 bp, Artificial Sequence
  Description of Artificial Sequence: Synthetic oligonucleotide
aggaaattgtttcagaagaggaccttcatacagcatctc

SEQ ID NO: 414691 - DNA, 38 bp, Artificial Sequence
  Description of Artificial Sequence: Synthetic oligonucleotide
ggaaattgtttcagaagaggaccttcatacagcatctc

SEQ ID NO: 414692 - DNA, 39 bp, Artificial Sequence
  Description of Artificial Sequence: Synthetic oligonucleotide
gaaattgtttcagaagaggaccttcatacagcatctctg

SEQ ID NO: 414693 - DNA, 40 bp, Artificial Sequence
  Description of Artificial Sequence: Synthetic oligonucleotide
aaattgtttcagaagaggaccttcatacagcatctctgac

SEQ ID NO: 414694 - DNA, 39 bp, Artificial Sequence
  Description of Artificial Sequence: Synthetic oligonucleotide
aattgtttcagaagaggaccttcatacagcatctctgac

SEQ ID NO: 414695 - DNA, 38 bp, Artificial Sequence
  Description of Artificial Sequence: Synthetic oligonucleotide
attgtttcagaagaggaccttcatacagcatctctgac

SEQ ID NO: 414696 - DNA, 37 bp, Artificial Sequence
  Description of Artificial Sequence: Synthetic oligonucleotide
ttgtttcagaagaggaccttcatacagcatctctgac

SEQ ID NO: 414697 - DNA, 36 bp, Artificial Sequence
  Description of Artificial Sequence: Synthetic oligonucleotide
catctctgaccagcgactgatgatgctattgtaatc

SEQ ID NO: 414698 - DNA, 37 bp, Artificial Sequence
  Description of Artificial Sequence: Synthetic oligonucleotide
atctctgaccagcgactgatgatgctattgtaatcag

SEQ ID NO: 414699 - DNA, 36 bp, Artificial Sequence
  Description of Artificial Sequence: Synthetic oligonucleotide
tctctgaccagcgactgatgatgctattgtaatcag

SEQ ID NO: 414700 - DNA, 35 bp, Artificial Sequence
  Description of Artificial Sequence: Synthetic oligonucleotide
ctctgaccagcgactgatgatgctattgtaatcag

SEQ ID NO: 414701 - DNA, 37 bp, Artificial Sequence
  Description of Artificial Sequence: Synthetic oligonucleotide
tctgaccagcgactgatgatgctattgtaatcagatg

SEQ ID NO: 414702 - DNA, 36 bp, Artificial Sequence
  Description of Artificial Sequence: Synthetic oligonucleotide
ctgaccagcgactgatgatgctattgtaatcagatg

SEQ ID NO: 414703 - DNA, 36 bp, Artificial Sequence
  Description of Artificial Sequence: Synthetic oligonucleotide
tgaccagcgactgatgatgctattgtaatcagatgc

SEQ ID NO: 414704 - DNA, 35 bp, Artificial Sequence
  Description of Artificial Sequence: Synthetic oligonucleotide
gaccagcgactgatgatgctattgtaatcagatgc

SEQ ID NO: 414705 - DNA, 36 bp, Artificial Sequence
  Description of Artificial Sequence: Synthetic oligonucleotide
accagcgactgatgatgctattgtaatcagatgctg

SEQ ID NO: 414706 - DNA, 35 bp, Artificial Sequence
  Description of Artificial Sequence: Synthetic oligonucleotide
ccagcgactgatgatgctattgtaatcagatgctg

SEQ ID NO: 414707 - DNA, 38 bp, Artificial Sequence
  Description of Artificial Sequence: Synthetic oligonucleotide
cagcgactgatgatgctattgtaatcagatgctgattc

SEQ ID NO: 414708 - DNA, 38 bp, Artificial Sequence
  Description of Artificial Sequence: Synthetic oligonucleotide
agcgactgatgatgctattgtaatcagatgctgattcg

SEQ ID NO: 414709 - DNA, 37 bp, Artificial Sequence
  Description of Artificial Sequence: Synthetic oligonucleotide
gcgactgatgatgctattgtaatcagatgctgattcg

SEQ ID NO: 414710 - DNA, 39 bp, Artificial Sequence
  Description of Artificial Sequence: Synthetic oligonucleotide
cgactgatgatgctattgtaatcagatgctgattcgttc

SEQ ID NO: 414711 - DNA, 40 bp, Artificial Sequence
  Description of Artificial Sequence: Synthetic oligonucleotide
gactgatgatgctattgtaatcagatgctgattcgttctc

SEQ ID NO: 414712 - DNA, 40 bp, Artificial Sequence
  Description of Artificial Sequence: Synthetic oligonucleotide
actgatgatgctattgtaatcagatgctgattcgttctcc

SEQ ID NO: 414713 - DNA, 39 bp, Artificial Sequence
  Description of Artificial Sequence: Synthetic oligonucleotide
ctgatgatgctattgtaatcagatgctgattcgttctcc

SEQ ID NO: 414714 - DNA, 41 bp, Artificial Sequence
  Description of Artificial Sequence: Synthetic oligonucleotide
tgatgatgctattgtaatcagatgctgattcgttctccaac

SEQ ID NO: 414715 - DNA, 40 bp, Artificial Sequence
  Description of Artificial Sequence: Synthetic oligonucleotide
gatgatgctattgtaatcagatgctgattcgttctccaac

SEQ ID NO: 414716 - DNA, 41 bp, Artificial Sequence
  Description of Artificial Sequence: Synthetic oligonucleotide
atgatgctattgtaatcagatgctgattcgttctccaacac

SEQ ID NO: 414717 - DNA, 40 bp, Artificial Sequence
  Description of Artificial Sequence: Synthetic oligonucleotide
tgatgctattgtaatcagatgctgattcgttctccaacac

SEQ ID NO: 414718 - DNA, 39 bp, Artificial Sequence
  Description of Artificial Sequence: Synthetic oligonucleotide
gatgctattgtaatcagatgctgattcgttctccaacac

SEQ ID NO: 414719 - DNA, 41 bp, Artificial Sequence
  Description of Artificial Sequence: Synthetic oligonucleotide
atgctattgtaatcagatgctgattcgttctccaacactag

SEQ ID NO: 414720 - DNA, 40 bp, Artificial Sequence
  Description of Artificial Sequence: Synthetic oligonucleotide
tgctattgtaatcagatgctgattcgttctccaacactag

SEQ ID NO: 414721 - DNA, 39 bp, Artificial Sequence
  Description of Artificial Sequence: Synthetic oligonucleotide
gctattgtaatcagatgctgattcgttctccaacactag

SEQ ID NO: 414722 - DNA, 43 bp, Artificial Sequence
  Description of Artificial Sequence: Synthetic oligonucleotide
ctattgtaatcagatgctgattcgttctccaacactagattac

SEQ ID NO: 414723 - DNA, 43 bp, Artificial Sequence
  Description of Artificial Sequence: Synthetic oligonucleotide
tattgtaatcagatgctgattcgttctccaacactagattacc

SEQ ID NO: 414724 - DNA, 42 bp, Artificial Sequence
  Description of Artificial Sequence: Synthetic oligonucleotide
attgtaatcagatgctgattcgttctccaacactagattacc

SEQ ID NO: 414725 - DNA, 41 bp, Artificial Sequence
  Description of Artificial Sequence: Synthetic oligonucleotide
ttgtaatcagatgctgattcgttctccaacactagattacc

SEQ ID NO: 414726 - DNA, 40 bp, Artificial Sequence
  Description of Artificial Sequence: Synthetic oligonucleotide
tgtaatcagatgctgattcgttctccaacactagattacc

SEQ ID NO: 414727 - DNA, 39 bp, Artificial Sequence
  Description of Artificial Sequence: Synthetic oligonucleotide
gtaatcagatgctgattcgttctccaacactagattacc

SEQ ID NO: 414728 - DNA, 39 bp, Artificial Sequence
  Description of Artificial Sequence: Synthetic oligonucleotide
taatcagatgctgattcgttctccaacactagattaccc

SEQ ID NO: 414729 - DNA, 38 bp, Artificial Sequence
  Description of Artificial Sequence: Synthetic oligonucleotide
aatcagatgctgattcgttctccaacactagattaccc

SEQ ID NO: 414730 - DNA, 37 bp, Artificial Sequence
  Description of Artificial Sequence: Synthetic oligonucleotide
atcagatgctgattcgttctccaacactagattaccc

SEQ ID NO: 414731 - DNA, 38 bp, Artificial Sequence
  Description of Artificial Sequence: Synthetic oligonucleotide
tgattcgttctccaacactagattacccaatccacaag

SEQ ID NO: 414732 - DNA, 37 bp, Artificial Sequence
  Description of Artificial Sequence: Synthetic oligonucleotide
gattcgttctccaacactagattacccaatccacaag

SEQ ID NO: 414733 - DNA, 37 bp, Artificial Sequence
  Description of Artificial Sequence: Synthetic oligonucleotide
attcgttctccaacactagattacccaatccacaagc

SEQ ID NO: 414734 - DNA, 36 bp, Artificial Sequence
  Description of Artificial Sequence: Synthetic oligonucleotide
ttcgttctccaacactagattacccaatccacaagc

SEQ ID NO: 414735 - DNA, 35 bp, Artificial Sequence
  Description of Artificial Sequence: Synthetic oligonucleotide
tcgttctccaacactagattacccaatccacaagc

SEQ ID NO: 414736 - DNA, 34 bp, Artificial Sequence
  Description of Artificial Sequence: Synthetic oligonucleotide
cgttctccaacactagattacccaatccacaagc

SEQ ID NO: 414737 - DNA, 36 bp, Artificial Sequence
  Description of Artificial Sequence: Synthetic oligonucleotide
gttctccaacactagattacccaatccacaagcaag

SEQ ID NO: 414738 - DNA, 36 bp, Artificial Sequence
  Description of Artificial Sequence: Synthetic oligonucleotide
ttctccaacactagattacccaatccacaagcaagg

SEQ ID NO: 414739 - DNA, 35 bp, Artificial Sequence
  Description of Artificial Sequence: Synthetic oligonucleotide
tctccaacactagattacccaatccacaagcaagg

SEQ ID NO: 414740 - DNA, 34 bp, Artificial Sequence
  Description of Artificial Sequence: Synthetic oligonucleotide
ctccaacactagattacccaatccacaagcaagg

SEQ ID NO: 414741 - DNA, 38 bp, Artificial Sequence
  Description of Artificial Sequence: Synthetic oligonucleotide
tccaacactagattacccaatccacaagcaaggaaatc

SEQ ID NO: 414742 - DNA, 37 bp, Artificial Sequence
  Description of Artificial Sequence: Synthetic oligonucleotide
ccaacactagattacccaatccacaagcaaggaaatc

SEQ ID NO: 414743 - DNA, 38 bp, Artificial Sequence
  Description of Artificial Sequence: Synthetic oligonucleotide
caacactagattacccaatccacaagcaaggaaatcag

SEQ ID NO: 414744 - DNA, 41 bp, Artificial Sequence
  Description of Artificial Sequence: Synthetic oligonucleotide
aacactagattacccaatccacaagcaaggaaatcagtaac

SEQ ID NO: 414745 - DNA, 40 bp, Artificial Sequence
  Description of Artificial Sequence: Synthetic oligonucleotide
acactagattacccaatccacaagcaaggaaatcagtaac

SEQ ID NO: 414746 - DNA, 39 bp, Artificial Sequence
  Description of Artificial Sequence: Synthetic oligonucleotide
cactagattacccaatccacaagcaaggaaatcagtaac

SEQ ID NO: 414747 - DNA, 41 bp, Artificial Sequence
  Description of Artificial Sequence: Synthetic oligonucleotide
actagattacccaatccacaagcaaggaaatcagtaacttc

SEQ ID NO: 414748 - DNA, 40 bp, Artificial Sequence
  Description of Artificial Sequence: Synthetic oligonucleotide
ctagattacccaatccacaagcaaggaaatcagtaacttc

SEQ ID NO: 414749 - DNA, 42 bp, Artificial Sequence
  Description of Artificial Sequence: Synthetic oligonucleotide
tagattacccaatccacaagcaaggaaatcagtaacttcttc

SEQ ID NO: 414750 - DNA, 41 bp, Artificial Sequence
  Description of Artificial Sequence: Synthetic oligonucleotide
agattacccaatccacaagcaaggaaatcagtaacttcttc

SEQ ID NO: 414751 - DNA, 40 bp, Artificial Sequence
  Description of Artificial Sequence: Synthetic oligonucleotide
gattacccaatccacaagcaaggaaatcagtaacttcttc

SEQ ID NO: 414752 - DNA, 40 bp, Artificial Sequence
  Description of Artificial Sequence: Synthetic oligonucleotide
attacccaatccacaagcaaggaaatcagtaacttcttcc

SEQ ID NO: 414753 - DNA, 39 bp, Artificial Sequence
  Description of Artificial Sequence: Synthetic oligonucleotide
ttacccaatccacaagcaaggaaatcagtaacttcttcc

SEQ ID NO: 414754 - DNA, 38 bp, Artificial Sequence
  Description of Artificial Sequence: Synthetic oligonucleotide
tacccaatccacaagcaaggaaatcagtaacttcttcc

SEQ ID NO: 414755 - DNA, 37 bp, Artificial Sequence
  Description of Artificial Sequence: Synthetic oligonucleotide
acccaatccacaagcaaggaaatcagtaacttcttcc

SEQ ID NO: 414756 - DNA, 36 bp, Artificial Sequence
  Description of Artificial Sequence: Synthetic oligonucleotide
cccaatccacaagcaaggaaatcagtaacttcttcc

SEQ ID NO: 414757 - DNA, 36 bp, Artificial Sequence
  Description of Artificial Sequence: Synthetic oligonucleotide
ccaatccacaagcaaggaaatcagtaacttcttccc

SEQ ID NO: 414758 - DNA, 44 bp, Artificial Sequence
  Description of Artificial Sequence: Synthetic oligonucleotide
caatccacaagcaaggaaatcagtaacttcttccctataatttg

SEQ ID NO: 414759 - DNA, 44 bp, Artificial Sequence
  Description of Artificial Sequence: Synthetic oligonucleotide
aatccacaagcaaggaaatcagtaacttcttccctataatttgg

SEQ ID NO: 414760 - DNA, 43 bp, Artificial Sequence
  Description of Artificial Sequence: Synthetic oligonucleotide
atccacaagcaaggaaatcagtaacttcttccctataatttgg

SEQ ID NO: 414761 - DNA, 42 bp, Artificial Sequence
  Description of Artificial Sequence: Synthetic oligonucleotide
tccacaagcaaggaaatcagtaacttcttccctataatttgg

SEQ ID NO: 414762 - DNA, 41 bp, Artificial Sequence
  Description of Artificial Sequence: Synthetic oligonucleotide
ccacaagcaaggaaatcagtaacttcttccctataatttgg

SEQ ID NO: 414763 - DNA, 44 bp, Artificial Sequence
  Description of Artificial Sequence: Synthetic oligonucleotide
cacaagcaaggaaatcagtaacttcttccctataatttggaatg

SEQ ID NO: 414764 - DNA, 45 bp, Artificial Sequence
  Description of Artificial Sequence: Synthetic oligonucleotide
acaagcaaggaaatcagtaacttcttccctataatttggaatgtg

SEQ ID NO: 414765 - DNA, 44 bp, Artificial Sequence
  Description of Artificial Sequence: Synthetic oligonucleotide
caagcaaggaaatcagtaacttcttccctataatttggaatgtg

SEQ ID NO: 414766 - DNA, 44 bp, Artificial Sequence
  Description of Artificial Sequence: Synthetic oligonucleotide
aagcaaggaaatcagtaacttcttccctataatttggaatgtgg

SEQ ID NO: 414767 - DNA, 26 bp, Artificial Sequence
  Description of Artificial Sequence: Synthetic oligonucleotide
tgaagctccctggaggctcctgcatg

SEQ ID NO: 414768 - DNA, 25 bp, Artificial Sequence
  Description of Artificial Sequence: Synthetic oligonucleotide
gaagctccctggaggctcctgcatg

SEQ ID NO: 414769 - DNA, 25 bp, Artificial Sequence
  Description of Artificial Sequence: Synthetic oligonucleotide
aagctccctggaggctcctgcatgg

SEQ ID NO: 414770 - DNA, 24 bp, Artificial Sequence
  Description of Artificial Sequence: Synthetic oligonucleotide
agctccctggaggctcctgcatgg

SEQ ID NO: 414771 - DNA, 26 bp, Artificial Sequence
  Description of Artificial Sequence: Synthetic oligonucleotide
cactggctttggctggggacacccaa

SEQ ID NO: 414772 - DNA, 26 bp, Artificial Sequence
  Description of Artificial Sequence: Synthetic oligonucleotide
actggctttggctggggacacccaac

SEQ ID NO: 414773 - DNA, 25 bp, Artificial Sequence
  Description of Artificial Sequence: Synthetic oligonucleotide
ctggctttggctggggacacccaac

SEQ ID NO: 414774 - DNA, 26 bp, Artificial Sequence
  Description of Artificial Sequence: Synthetic oligonucleotide
tggctttggctggggacacccaacca

SEQ ID NO: 414775 - DNA, 25 bp, Artificial Sequence
  Description of Artificial Sequence: Synthetic oligonucleotide
ggctttggctggggacacccaacca

SEQ ID NO: 414776 - DNA, 25 bp, Artificial Sequence
  Description of Artificial Sequence: Synthetic oligonucleotide
gctttggctggggacacccaaccac

SEQ ID NO: 414777 - DNA, 27 bp, Artificial Sequence
  Description of Artificial Sequence: Synthetic oligonucleotide
ctttggctggggacacccaaccacgtt

SEQ ID NO: 414778 - DNA, 28 bp, Artificial Sequence
  Description of Artificial Sequence: Synthetic oligonucleotide
tttggctggggacacccaaccacgtttc

SEQ ID NO: 414779 - DNA, 27 bp, Artificial Sequence
  Description of Artificial Sequence: Synthetic oligonucleotide
ttggctggggacacccaaccacgtttc

SEQ ID NO: 414780 - DNA, 26 bp, Artificial Sequence
  Description of Artificial Sequence: Synthetic oligonucleotide
tggctggggacacccaaccacgtttc

SEQ ID NO: 414781 - DNA, 25 bp, Artificial Sequence
  Description of Artificial Sequence: Synthetic oligonucleotide
ggctggggacacccaaccacgtttc

SEQ ID NO: 414782 - DNA, 26 bp, Artificial Sequence
  Description of Artificial Sequence: Synthetic oligonucleotide
gctggggacacccaaccacgtttcct

SEQ ID NO: 414783 - DNA, 27 bp, Artificial Sequence
  Description of Artificial Sequence: Synthetic oligonucleotide
ctggggacacccaaccacgtttcctgt

SEQ ID NO: 414784 - DNA, 27 bp, Artificial Sequence
  Description of Artificial Sequence: Synthetic oligonucleotide
tggggacacccaaccacgtttcctgtg

SEQ ID NO: 414785 - DNA, 26 bp, Artificial Sequence
  Description of Artificial Sequence: Synthetic oligonucleotide
ggggacacccaaccacgtttcctgtg

SEQ ID NO: 414786 - DNA, 26 bp, Artificial Sequence
  Description of Artificial Sequence: Synthetic oligonucleotide
gggacacccaaccacgtttcctgtgg

SEQ ID NO: 414787 - DNA, 27 bp, Artificial Sequence
  Description of Artificial Sequence: Synthetic oligonucleotide
ggacacccaaccacgtttcctgtggca

SEQ ID NO: 414788 - DNA, 27 bp, Artificial Sequence
  Description of Artificial Sequence: Synthetic oligonucleotide
gacacccaaccacgtttcctgtggcag

SEQ ID NO: 414789 - DNA, 27 bp, Artificial Sequence
  Description of Artificial Sequence: Synthetic oligonucleotide
acacccaaccacgtttcctgtggcagg

SEQ ID NO: 414790 - DNA, 26 bp, Artificial Sequence
  Description of Artificial Sequence: Synthetic oligonucleotide
cacccaaccacgtttcctgtggcagg

SEQ ID NO: 414791 - DNA, 27 bp, Artificial Sequence
  Description of Artificial Sequence: Synthetic oligonucleotide
acccaaccacgtttcctgtggcagggt

SEQ ID NO: 414792 - DNA, 27 bp, Artificial Sequence
  Description of Artificial Sequence: Synthetic oligonucleotide
cccaaccacgtttcctgtggcagggta

SEQ ID NO: 414793 - DNA, 28 bp, Artificial Sequence
  Description of Artificial Sequence: Synthetic oligonucleotide
ccaaccacgtttcctgtggcagggtaag

SEQ ID NO: 414794 - DNA, 33 bp, Artificial Sequence; identical to SEQ ID NO: 68011
  Description of Artificial Sequence: Synthetic oligonucleotide

SEQ ID NO: 414795 - DNA, 34 bp, Artificial Sequence; identical to SEQ ID NO: 68012
  Description of Artificial Sequence: Synthetic oligonucleotide

SEQ ID NO: 414796 - DNA, 33 bp, Artificial Sequence; identical to SEQ ID NO: 68013
  Description of Artificial Sequence: Synthetic oligonucleotide

SEQ ID NO: 414797 - DNA, 32 bp, Artificial Sequence; identical to SEQ ID NO: 68014
  Description of Artificial Sequence: Synthetic oligonucleotide

SEQ ID NO: 414798 - DNA, 33 bp, Artificial Sequence; identical to SEQ ID NO: 68015
  Description of Artificial Sequence: Synthetic oligonucleotide

SEQ ID NO: 414799 - DNA, 37 bp, Artificial Sequence; identical to SEQ ID NO: 68016
  Description of Artificial Sequence: Synthetic oligonucleotide

SEQ ID NO: 414800 - DNA, 36 bp, Artificial Sequence; identical to SEQ ID NO: 68017
  Description of Artificial Sequence: Synthetic oligonucleotide

SEQ ID NO: 414801 - DNA, 38 bp, Artificial Sequence; identical to SEQ ID NO: 68018
  Description of Artificial Sequence: Synthetic oligonucleotide

SEQ ID NO: 414802 - DNA, 40 bp, Artificial Sequence; identical to SEQ ID NO: 68019
  Description of Artificial Sequence: Synthetic oligonucleotide

SEQ ID NO: 414803 - DNA, 39 bp, Artificial Sequence; identical to SEQ ID NO: 68020
  Description of Artificial Sequence: Synthetic oligonucleotide

SEQ ID NO: 414804 - DNA, 38 bp, Artificial Sequence; identical to SEQ ID NO: 68021
  Description of Artificial Sequence: Synthetic oligonucleotide

SEQ ID NO: 414805 - DNA, 37 bp, Artificial Sequence; identical to SEQ ID NO: 68022
  Description of Artificial Sequence: Synthetic oligonucleotide

SEQ ID NO: 414806 - DNA, 37 bp, Artificial Sequence; identical to SEQ ID NO: 68023
  Description of Artificial Sequence: Synthetic oligonucleotide

SEQ ID NO: 414807 - DNA, 37 bp, Artificial Sequence; identical to SEQ ID NO: 68024
  Description of Artificial Sequence: Synthetic oligonucleotide

SEQ ID NO: 414808 - DNA, 36 bp, Artificial Sequence; identical to SEQ ID NO: 68025
  Description of Artificial Sequence: Synthetic oligonucleotide

SEQ ID NO: 414809 - DNA, 36 bp, Artificial Sequence; identical to SEQ ID NO: 68026
  Description of Artificial Sequence: Synthetic oligonucleotide

SEQ ID NO: 414810 - DNA, 35 bp, Artificial Sequence; identical to SEQ ID NO: 68027
  Description of Artificial Sequence: Synthetic oligonucleotide

SEQ ID NO: 414811 - DNA, 36 bp, Artificial Sequence; identical to SEQ ID NO: 68028
  Description of Artificial Sequence: Synthetic oligonucleotide

SEQ ID NO: 414812 - DNA, 36 bp, Artificial Sequence; identical to SEQ ID NO: 68029
  Description of Artificial Sequence: Synthetic oligonucleotide

SEQ ID NO: 414813 - DNA, 36 bp, Artificial Sequence; identical to SEQ ID NO: 68030
  Description of Artificial Sequence: Synthetic oligonucleotide

SEQ ID NO: 414814 - DNA, 35 bp, Artificial Sequence; identical to SEQ ID NO: 68031
  Description of Artificial Sequence: Synthetic oligonucleotide

SEQ ID NO: 414815 - DNA, 36 bp, Artificial Sequence; identical to SEQ ID NO: 68032
  Description of Artificial Sequence: Synthetic oligonucleotide

SEQ ID NO: 414816 - DNA, 36 bp, Artificial Sequence; identical to SEQ ID NO: 68033
  Description of Artificial Sequence: Synthetic oligonucleotide

SEQ ID NO: 414817 - DNA, 36 bp, Artificial Sequence; identical to SEQ ID NO: 68034
  Description of Artificial Sequence: Synthetic oligonucleotide

SEQ ID NO: 414818 - DNA, 35 bp, Artificial Sequence; identical to SEQ ID NO: 68035
  Description of Artificial Sequence: Synthetic oligonucleotide

SEQ ID NO: 414819 - DNA, 34 bp, Artificial Sequence; identical to SEQ ID NO: 68036
  Description of Artificial Sequence: Synthetic oligonucleotide

SEQ ID NO: 414820 - DNA, 33 bp, Artificial Sequence; identical to SEQ ID NO: 68037
  Description of Artificial Sequence: Synthetic oligonucleotide

SEQ ID NO: 414821 - DNA, 33 bp, Artificial Sequence; identical to SEQ ID NO: 68038
  Description of Artificial Sequence: Synthetic oligonucleotide

SEQ ID NO: 414822 - DNA, 32 bp, Artificial Sequence; identical to SEQ ID NO: 68039
  Description of Artificial Sequence: Synthetic oligonucleotide

SEQ ID NO: 414823 - DNA, 31 bp, Artificial Sequence; identical to SEQ ID NO: 68040
  Description of Artificial Sequence: Synthetic oligonucleotide

SEQ ID NO: 414824 - DNA, 30 bp, Artificial Sequence; identical to SEQ ID NO: 68041
  Description of Artificial Sequence: Synthetic oligonucleotide

SEQ ID NO: 414825 - DNA, 34 bp, Artificial Sequence; identical to SEQ ID NO: 68042
  Description of Artificial Sequence: Synthetic oligonucleotide

SEQ ID NO: 414826 - DNA, 34 bp, Artificial Sequence; identical to SEQ ID NO: 68043
  Description of Artificial Sequence: Synthetic oligonucleotide

SEQ ID NO: 414827 - DNA, 35 bp, Artificial Sequence; identical to SEQ ID NO: 68044
  Description of Artificial Sequence: Synthetic oligonucleotide

SEQ ID NO: 414828 - DNA, 34 bp, Artificial Sequence; identical to SEQ ID NO: 68045
  Description of Artificial Sequence: Synthetic oligonucleotide

SEQ ID NO: 414829 - DNA, 34 bp, Artificial Sequence; identical to SEQ ID NO: 68046
  Description of Artificial Sequence: Synthetic oligonucleotide

SEQ ID NO: 414830 - DNA, 35 bp, Artificial Sequence; identical to SEQ ID NO: 68047
  Description of Artificial Sequence: Synthetic oligonucleotide

SEQ ID NO: 414831 - DNA, 34 bp, Artificial Sequence; identical to SEQ ID NO: 68048
  Description of Artificial Sequence: Synthetic oligonucleotide

SEQ ID NO: 414832 - DNA, 36 bp, Artificial Sequence; identical to SEQ ID NO: 68049
  Description of Artificial Sequence: Synthetic oligonucleotide

SEQ ID NO: 414833 - DNA, 35 bp, Artificial Sequence; identical to SEQ ID NO: 68050
  Description of Artificial Sequence: Synthetic oligonucleotide

SEQ ID NO: 414834 - DNA, 34 bp, Artificial Sequence; identical to SEQ ID NO: 68051
  Description of Artificial Sequence: Synthetic oligonucleotide

SEQ ID NO: 414835 - DNA, 34 bp, Artificial Sequence; identical to SEQ ID NO: 68052
  Description of Artificial Sequence: Synthetic oligonucleotide

SEQ ID NO: 414836 - DNA, 35 bp, Artificial Sequence; identical to SEQ ID NO: 68053
  Description of Artificial Sequence: Synthetic oligonucleotide

SEQ ID NO: 414837 - DNA, 34 bp, Artificial Sequence; identical to SEQ ID NO: 68054
  Description of Artificial Sequence: Synthetic oligonucleotide

SEQ ID NO: 414838 - DNA, 34 bp, Artificial Sequence; identical to SEQ ID NO: 68055
  Description of Artificial Sequence: Synthetic oligonucleotide

SEQ ID NO: 414839 - DNA, 34 bp, Artificial Sequence; identical to SEQ ID NO: 68056
  Description of Artificial Sequence: Synthetic oligonucleotide

SEQ ID NO: 414840 - DNA, 33 bp, Artificial Sequence; identical to SEQ ID NO: 68057
  Description of Artificial Sequence: Synthetic oligonucleotide

SEQ ID NO: 414841 - DNA, 32 bp, Artificial Sequence; identical to SEQ ID NO: 68058
  Description of Artificial Sequence: Synthetic oligonucleotide

SEQ ID NO: 414842 - DNA, 31 bp, Artificial Sequence; identical to SEQ ID NO: 68059
  Description of Artificial Sequence: Synthetic oligonucleotide

SEQ ID NO: 414843 - DNA, 31 bp, Artificial Sequence; identical to SEQ ID NO: 68060
  Description of Artificial Sequence: Synthetic oligonucleotide

SEQ ID NO: 414844 - DNA, 30 bp, Artificial Sequence; identical to SEQ ID NO: 68061
  Description of Artificial Sequence: Synthetic oligonucleotide

SEQ ID NO: 414845 - DNA, 32 bp, Artificial Sequence; identical to SEQ ID NO: 68062
  Description of Artificial Sequence: Synthetic oligonucleotide

SEQ ID NO: 414846 - DNA, 31 bp, Artificial Sequence; identical to SEQ ID NO: 68063
  Description of Artificial Sequence: Synthetic oligonucleotide

SEQ ID NO: 414847 - DNA, 31 bp, Artificial Sequence; identical to SEQ ID NO: 68064
  Description of Artificial Sequence: Synthetic oligonucleotide

SEQ ID NO: 414848 - DNA, 30 bp, Artificial Sequence; identical to SEQ ID NO: 68065
  Description of Artificial Sequence: Synthetic oligonucleotide

SEQ ID NO: 414849 - DNA, 29 bp, Artificial Sequence
  Description of Artificial Sequence: Synthetic oligonucleotide
ctataaccaggaggagttcgtgcgcttcg

SEQ ID NO: 414850 - DNA, 30 bp, Artificial Sequence; identical to SEQ ID NO: 68067
  Description of Artificial Sequence: Synthetic oligonucleotide

SEQ ID NO: 414851 - DNA, 24 bp, Artificial Sequence
  Description of Artificial Sequence: Synthetic oligonucleotide
gagtaccgggcggtgacggagcta

SEQ ID NO: 414852 - DNA, 24 bp, Artificial Sequence
  Description of Artificial Sequence: Synthetic oligonucleotide
agtaccgggcggtgacggagctag

SEQ ID NO: 414853 - DNA, 23 bp, Artificial Sequence
  Description of Artificial Sequence: Synthetic oligonucleotide
gtaccgggcggtgacggagctag

SEQ ID NO: 414854 - DNA, 23 bp, Artificial Sequence
  Description of Artificial Sequence: Synthetic oligonucleotide
taccgggcggtgacggagctagg

SEQ ID NO: 414855 - DNA, 22 bp, Artificial Sequence
  Description of Artificial Sequence: Synthetic oligonucleotide
accgggcggtgacggagctagg

SEQ ID NO: 414856 - DNA, 21 bp, Artificial Sequence
  Description of Artificial Sequence: Synthetic oligonucleotide
ccgggcggtgacggagctagg

SEQ ID NO: 414857 - DNA, 21 bp, Artificial Sequence
  Description of Artificial Sequence: Synthetic oligonucleotide
cgggcggtgacggagctaggg

SEQ ID NO: 414858 - DNA, 21 bp, Artificial Sequence
  Description of Artificial Sequence: Synthetic oligonucleotide
gggcggtgacggagctagggc

SEQ ID NO: 414859 - DNA, 21 bp, Artificial Sequence
  Description of Artificial Sequence: Synthetic oligonucleotide
ggcggtgacggagctagggcg

SEQ ID NO: 414860 - DNA, 21 bp, Artificial Sequence
  Description of Artificial Sequence: Synthetic oligonucleotide
gcggtgacggagctagggcgg

SEQ ID NO: 414861 - DNA, 21 bp, Artificial Sequence
  Description of Artificial Sequence: Synthetic oligonucleotide
cggtgacggagctagggcggc

SEQ ID NO: 414862 - DNA, 22 bp, Artificial Sequence
  Description of Artificial Sequence: Synthetic oligonucleotide
ggtgacggagctagggcggcct

SEQ ID NO: 414863 - DNA, 23 bp, Artificial Sequence
  Description of Artificial Sequence: Synthetic oligonucleotide
gtgacggagctagggcggcctgt

SEQ ID NO: 414864 - DNA, 23 bp, Artificial Sequence
  Description of Artificial Sequence: Synthetic oligonucleotide
tgacggagctagggcggcctgtc

SEQ ID NO: 414865 - DNA, 22 bp, Artificial Sequence
  Description of Artificial Sequence: Synthetic oligonucleotide
gacggagctagggcggcctgtc

SEQ ID NO: 414866 - DNA, 22 bp, Artificial Sequence
  Description of Artificial Sequence: Synthetic oligonucleotide
acggagctagggcggcctgtcg

SEQ ID NO: 414867 - DNA, 21 bp, Artificial Sequence
  Description of Artificial Sequence: Synthetic oligonucleotide
cggagctagggcggcctgtcg

SEQ ID NO: 414868 - DNA, 21 bp, Artificial Sequence
  Description of Artificial Sequence: Synthetic oligonucleotide
ggagctagggcggcctgtcgc

SEQ ID NO: 414869 - DNA, 21 bp, Artificial Sequence
  Description of Artificial Sequence: Synthetic oligonucleotide
gagctagggcggcctgtcgcc

SEQ ID NO: 414870 - DNA, 22 bp, Artificial Sequence
  Description of Artificial Sequence: Synthetic oligonucleotide
agctagggcggcctgtcgccga

SEQ ID NO: 414871 - DNA, 21 bp, Artificial Sequence
  Description of Artificial Sequence: Synthetic oligonucleotide
gctagggcggcctgtcgccga

SEQ ID NO: 414872 - DNA, 22 bp, Artificial Sequence
  Description of Artificial Sequence: Synthetic oligonucleotide
ctagggcggcctgtcgccgagt

SEQ ID NO: 414873 - DNA, 22 bp, Artificial Sequence
  Description of Artificial Sequence: Synthetic oligonucleotide
tagggcggcctgtcgccgagtc

SEQ ID NO: 414874 - DNA, 21 bp, Artificial Sequence
  Description of Artificial Sequence: Synthetic oligonucleotide
agggcggcctgtcgccgagtc

SEQ ID NO: 414875 - DNA, 28 bp, Artificial Sequence
  Description of Artificial Sequence: Synthetic oligonucleotide
gaacagccagaaggacatcctggaggac

SEQ ID NO: 414876 - DNA, 29 bp, Artificial Sequence
  Description of Artificial Sequence: Synthetic oligonucleotide
aacagccagaaggacatcctggaggacag

SEQ ID NO: 414877 - DNA, 28 bp, Artificial Sequence
  Description of Artificial Sequence: Synthetic oligonucleotide
acagccagaaggacatcctggaggacag

SEQ ID NO: 414878 - DNA, 27 bp, Artificial Sequence
  Description of Artificial Sequence: Synthetic oligonucleotide
cagccagaaggacatcctggaggacag

SEQ ID NO: 414879 - DNA, 27 bp, Artificial Sequence
  Description of Artificial Sequence: Synthetic oligonucleotide
agccagaaggacatcctggaggacagg

SEQ ID NO: 414880 - DNA, 26 bp, Artificial Sequence
  Description of Artificial Sequence: Synthetic oligonucleotide
gccagaaggacatcctggaggacagg

SEQ ID NO: 414881 - DNA, 26 bp, Artificial Sequence
  Description of Artificial Sequence: Synthetic oligonucleotide
ccagaaggacatcctggaggacaggc

SEQ ID NO: 414882 - DNA, 26 bp, Artificial Sequence
  Description of Artificial Sequence: Synthetic oligonucleotide
cagaaggacatcctggaggacaggcg

SEQ ID NO: 414883 - DNA, 26 bp, Artificial Sequence
  Description of Artificial Sequence: Synthetic oligonucleotide
agaaggacatcctggaggacaggcgg

SEQ ID NO: 414884 - DNA, 25 bp, Artificial Sequence
  Description of Artificial Sequence: Synthetic oligonucleotide
gaaggacatcctggaggacaggcgg

SEQ ID NO: 414885 - DNA, 25 bp, Artificial Sequence
  Description of Artificial Sequence: Synthetic oligonucleotide
aaggacatcctggaggacaggcggg

SEQ ID NO: 414886 - DNA, 24 bp, Artificial Sequence
  Description of Artificial Sequence: Synthetic oligonucleotide
aggacatcctggaggacaggcggg

SEQ ID NO: 414887 - DNA, 23 bp, Artificial Sequence
  Description of Artificial Sequence: Synthetic oligonucleotide
ggacatcctggaggacaggcggg

SEQ ID NO: 414888 - DNA, 23 bp, Artificial Sequence
  Description of Artificial Sequence: Synthetic oligonucleotide
gacatcctggaggacaggcgggg

SEQ ID NO: 414889 - DNA, 23 bp, Artificial Sequence
  Description of Artificial Sequence: Synthetic oligonucleotide
acatcctggaggacaggcggggc

SEQ ID NO: 414890 - DNA, 22 bp, Artificial Sequence
  Description of Artificial Sequence: Synthetic oligonucleotide
catcctggaggacaggcggggc

SEQ ID NO: 414891 - DNA, 23 bp, Artificial Sequence
  Description of Artificial Sequence: Synthetic oligonucleotide
atcctggaggacaggcggggcca

SEQ ID NO: 414892 - DNA, 22 bp, Artificial Sequence
  Description of Artificial Sequence: Synthetic oligonucleotide
tcctggaggacaggcggggcca

SEQ ID NO: 414893 - DNA, 21 bp, Artificial Sequence
  Description of Artificial Sequence: Synthetic oligonucleotide
cctggaggacaggcggggcca

SEQ ID NO: 414894 - DNA, 21 bp, Artificial Sequence
  Description of Artificial Sequence: Synthetic oligonucleotide
ctggaggacaggcggggccag

SEQ ID NO: 414895 - DNA, 22 bp, Artificial Sequence
  Description of Artificial Sequence: Synthetic oligonucleotide
tggaggacaggcggggccaggt

SEQ ID NO: 414896 - DNA, 21 bp, Artificial Sequence
  Description of Artificial Sequence: Synthetic oligonucleotide
ggaggacaggcggggccaggt

SEQ ID NO: 414897 - DNA, 21 bp, Artificial Sequence
  Description of Artificial Sequence: Synthetic oligonucleotide
gaggacaggcggggccaggtg

SEQ ID NO: 414898 - DNA, 22 bp, Artificial Sequence
  Description of Artificial Sequence: Synthetic oligonucleotide
aggacaggcggggccaggtgga

SEQ ID NO: 414899 - DNA, 21 bp, Artificial Sequence
  Description of Artificial Sequence: Synthetic oligonucleotide
ggacaggcggggccaggtgga

SEQ ID NO: 414900 - DNA, 22 bp, Artificial Sequence
  Description of Artificial Sequence: Synthetic oligonucleotide
gacaggcggggccaggtggaca

SEQ ID NO: 414901 - DNA, 22 bp, Artificial Sequence
  Description of Artificial Sequence: Synthetic oligonucleotide
acaggcggggccaggtggacac

SEQ ID NO: 414902 - DNA, 21 bp, Artificial Sequence
  Description of Artificial Sequence: Synthetic oligonucleotide
caggcggggccaggtggacac

SEQ ID NO: 414903 - DNA, 21 bp, Artificial Sequence
  Description of Artificial Sequence: Synthetic oligonucleotide
aggcggggccaggtggacacc

SEQ ID NO: 414904 - DNA, 20 bp, Artificial Sequence
  Description of Artificial Sequence: Synthetic oligonucleotide
ggcggggccaggtggacacc

SEQ ID NO: 414905 - DNA, 21 bp, Artificial Sequence
  Description of Artificial Sequence: Synthetic oligonucleotide
gcggggccaggtggacaccgt

SEQ ID NO: 414906 - DNA, 22 bp, Artificial Sequence
  Description of Artificial Sequence: Synthetic oligonucleotide
cggggccaggtggacaccgtgt

SEQ ID NO: 414907 - DNA, 22 bp, Artificial Sequence
  Description of Artificial Sequence: Synthetic oligonucleotide
ggggccaggtggacaccgtgtg

SEQ ID NO: 414908 - DNA, 23 bp, Artificial Sequence
  Description of Artificial Sequence: Synthetic oligonucleotide
gggccaggtggacaccgtgtgca

SEQ ID NO: 414909 - DNA, 24 bp, Artificial Sequence
  Description of Artificial Sequence: Synthetic oligonucleotide
ggccaggtggacaccgtgtgcaga

SEQ ID NO: 414910 - DNA, 25 bp, Artificial Sequence
  Description of Artificial Sequence: Synthetic oligonucleotide
gccaggtggacaccgtgtgcagaca

SEQ ID NO: 414911 - DNA, 27 bp, Artificial Sequence
  Description of Artificial Sequence: Synthetic oligonucleotide
ccaggtggacaccgtgtgcagacacaa

SEQ ID NO: 414912 - DNA, 27 bp, Artificial Sequence
  Description of Artificial Sequence: Synthetic oligonucleotide
caggtggacaccgtgtgcagacacaac

SEQ ID NO: 414913 - DNA, 29 bp, Artificial Sequence
  Description of Artificial Sequence: Synthetic oligonucleotide
aggtggacaccgtgtgcagacacaactac

SEQ ID NO: 414914 - DNA, 26 bp, Artificial Sequence
  Description of Artificial Sequence: Synthetic oligonucleotide
tcacagtgcagcggcgagtccatcct

SEQ ID NO: 414915 - DNA, 25 bp, Artificial Sequence
  Description of Artificial Sequence: Synthetic oligonucleotide
cacagtgcagcggcgagtccatcct

SEQ ID NO: 414916 - DNA, 26 bp, Artificial Sequence
  Description of Artificial Sequence: Synthetic oligonucleotide
acagtgcagcggcgagtccatcctga

SEQ ID NO: 414917 - DNA, 25 bp, Artificial Sequence
  Description of Artificial Sequence: Synthetic oligonucleotide
cagtgcagcggcgagtccatcctga

SEQ ID NO: 414918 - DNA, 25 bp, Artificial Sequence
  Description of Artificial Sequence: Synthetic oligonucleotide
agtgcagcggcgagtccatcctgag

SEQ ID NO: 414919 - DNA, 24 bp, Artificial Sequence
  Description of Artificial Sequence: Synthetic oligonucleotide
gtgcagcggcgagtccatcctgag

SEQ ID NO: 414920 - DNA, 25 bp, Artificial Sequence
  Description of Artificial Sequence: Synthetic oligonucleotide
tgcagcggcgagtccatcctgaggt

SEQ ID NO: 414921 - DNA, 24 bp, Artificial Sequence
  Description of Artificial Sequence: Synthetic oligonucleotide
gcagcggcgagtccatcctgaggt

SEQ ID NO: 414922 - DNA, 25 bp, Artificial Sequence
  Description of Artificial Sequence: Synthetic oligonucleotide
cagcggcgagtccatcctgaggtga

SEQ ID NO: 414923 - DNA, 26 bp, Artificial Sequence
  Description of Artificial Sequence: Synthetic oligonucleotide
agcggcgagtccatcctgaggtgact

SEQ ID NO: 414924 - DNA, 25 bp, Artificial Sequence
  Description of Artificial Sequence: Synthetic oligonucleotide
gcggcgagtccatcctgaggtgact

SEQ ID NO: 414925 - DNA, 26 bp, Artificial Sequence
  Description of Artificial Sequence: Synthetic oligonucleotide
cggcgagtccatcctgaggtgactgt

SEQ ID NO: 414926 - DNA, 27 bp, Artificial Sequence
  Description of Artificial Sequence: Synthetic oligonucleotide
ggcgagtccatcctgaggtgactgtgt

SEQ ID NO: 414927 - DNA, 29 bp, Artificial Sequence
  Description of Artificial Sequence: Synthetic oligonucleotide
gcgagtccatcctgaggtgactgtgtatc

SEQ ID NO: 414928 - DNA, 29 bp, Artificial Sequence
  Description of Artificial Sequence: Synthetic oligonucleotide
cgagtccatcctgaggtgactgtgtatcc

SEQ ID NO: 414929 - DNA, 30 bp, Artificial Sequence; identical to SEQ ID NO: 68146
  Description of Artificial Sequence: Synthetic oligonucleotide

SEQ ID NO: 414930 - DNA, 30 bp, Artificial Sequence; identical to SEQ ID NO: 68147
  Description of Artificial Sequence: Synthetic oligonucleotide

SEQ ID NO: 414931 - DNA, 29 bp, Artificial Sequence
  Description of Artificial Sequence: Synthetic oligonucleotide
gtccatcctgaggtgactgtgtatcctgc

SEQ ID NO: 414932 - DNA, 29 bp, Artificial Sequence
  Description of Artificial Sequence: Synthetic oligonucleotide
tccatcctgaggtgactgtgtatcctgcc

SEQ ID NO: 414933 - DNA, 28 bp, Artificial Sequence
  Description of Artificial Sequence: Synthetic oligonucleotide
ccatcctgaggtgactgtgtatcctgcc

SEQ ID NO: 414934 - DNA, 30 bp, Artificial Sequence; identical to SEQ ID NO: 68151
  Description of Artificial Sequence: Synthetic oligonucleotide

SEQ ID NO: 414935 - DNA, 31 bp, Artificial Sequence; identical to SEQ ID NO: 68152
  Description of Artificial Sequence: Synthetic oligonucleotide

SEQ ID NO: 414936 - DNA, 30 bp, Artificial Sequence; identical to SEQ ID NO: 68153
  Description of Artificial Sequence: Synthetic oligonucleotide

SEQ ID NO: 414937 - DNA, 29 bp, Artificial Sequence
  Description of Artificial Sequence: Synthetic oligonucleotide
cctgaggtgactgtgtatcctgccaagac

SEQ ID NO: 414938 - DNA, 30 bp, Artificial Sequence; identical to SEQ ID NO: 68155
  Description of Artificial Sequence: Synthetic oligonucleotide

SEQ ID NO: 414939 - DNA, 31 bp, Artificial Sequence; identical to SEQ ID NO: 68156
  Description of Artificial Sequence: Synthetic oligonucleotide

SEQ ID NO: 414940 - DNA, 30 bp, Artificial Sequence; identical to SEQ ID NO: 68157
  Description of Artificial Sequence: Synthetic oligonucleotide

SEQ ID NO: 414941 - DNA, 30 bp, Artificial Sequence; identical to SEQ ID NO: 68158
  Description of Artificial Sequence: Synthetic oligonucleotide

SEQ ID NO: 414942 - DNA, 29 bp, Artificial Sequence
  Description of Artificial Sequence: Synthetic oligonucleotide
ggtgactgtgtatcctgccaagactcagc

SEQ ID NO: 414943 - DNA, 29 bp, Artificial Sequence
  Description of Artificial Sequence: Synthetic oligonucleotide
gtgactgtgtatcctgccaagactcagcc

SEQ ID NO: 414944 - DNA, 29 bp, Artificial Sequence
  Description of Artificial Sequence: Synthetic oligonucleotide
tgactgtgtatcctgccaagactcagccc

SEQ ID NO: 414945 - DNA, 28 bp, Artificial Sequence
  Description of Artificial Sequence: Synthetic oligonucleotide
gactgtgtatcctgccaagactcagccc

SEQ ID NO: 414946 - DNA, 28 bp, Artificial Sequence
  Description of Artificial Sequence: Synthetic oligonucleotide
actgtgtatcctgccaagactcagcccc

SEQ ID NO: 414947 - DNA, 27 bp, Artificial Sequence
  Description of Artificial Sequence: Synthetic oligonucleotide
ctgtgtatcctgccaagactcagcccc

SEQ ID NO: 414948 - DNA, 28 bp, Artificial Sequence
  Description of Artificial Sequence: Synthetic oligonucleotide
tgtgtatcctgccaagactcagcccctg

SEQ ID NO: 414949 - DNA, 27 bp, Artificial Sequence
  Description of Artificial Sequence: Synthetic oligonucleotide
gtgtatcctgccaagactcagcccctg

SEQ ID NO: 414950 - DNA, 27 bp, Artificial Sequence
  Description of Artificial Sequence: Synthetic oligonucleotide
tgtatcctgccaagactcagcccctgc

SEQ ID NO: 414951 - DNA, 27 bp, Artificial Sequence
  Description of Artificial Sequence: Synthetic oligonucleotide
gtatcctgccaagactcagcccctgca

SEQ ID NO: 414952 - DNA, 27 bp, Artificial Sequence
  Description of Artificial Sequence: Synthetic oligonucleotide
tatcctgccaagactcagcccctgcag

SEQ ID NO: 414953 - DNA, 26 bp, Artificial Sequence
  Description of Artificial Sequence: Synthetic oligonucleotide
atcctgccaagactcagcccctgcag

SEQ ID NO: 414954 - DNA, 25 bp, Artificial Sequence
  Description of Artificial Sequence: Synthetic oligonucleotide
tcctgccaagactcagcccctgcag

SEQ ID NO: 414955 - DNA, 24 bp, Artificial Sequence
  Description of Artificial Sequence: Synthetic oligonucleotide
cctgccaagactcagcccctgcag

SEQ ID NO: 414956 - DNA, 25 bp, Artificial Sequence
  Description of Artificial Sequence: Synthetic oligonucleotide
ctgccaagactcagcccctgcagca

SEQ ID NO: 414957 - DNA, 25 bp, Artificial Sequence
  Description of Artificial Sequence: Synthetic oligonucleotide
tgccaagactcagcccctgcagcac

SEQ ID NO: 414958 - DNA, 24 bp, Artificial Sequence
  Description of Artificial Sequence: Synthetic oligonucleotide
gccaagactcagcccctgcagcac

SEQ ID NO: 414959 - DNA, 25 bp, Artificial Sequence
  Description of Artificial Sequence: Synthetic oligonucleotide
ccaagactcagcccctgcagcacca

SEQ ID NO: 414960 - DNA, 27 bp, Artificial Sequence
  Description of Artificial Sequence: Synthetic oligonucleotide
caagactcagcccctgcagcaccacaa

SEQ ID NO: 414961 - DNA, 27 bp, Artificial Sequence
  Description of Artificial Sequence: Synthetic oligonucleotide
aagactcagcccctgcagcaccacaac

SEQ ID NO: 414962 - DNA, 26 bp, Artificial Sequence
  Description of Artificial Sequence: Synthetic oligonucleotide
agactcagcccctgcagcaccacaac

SEQ ID NO: 414963 - DNA, 25 bp, Artificial Sequence
  Description of Artificial Sequence: Synthetic oligonucleotide
gactcagcccctgcagcaccacaac

SEQ ID NO: 414964 - DNA, 26 bp, Artificial Sequence
  Description of Artificial Sequence: Synthetic oligonucleotide
actcagcccctgcagcaccacaacct

SEQ ID NO: 414965 - DNA, 25 bp, Artificial Sequence
  Description of Artificial Sequence: Synthetic oligonucleotide
ctcagcccctgcagcaccacaacct

SEQ ID NO: 414966 - DNA, 25 bp, Artificial Sequence
  Description of Artificial Sequence: Synthetic oligonucleotide
tcagcccctgcagcaccacaacctc

SEQ ID NO: 414967 - DNA, 31 bp, Artificial Sequence; identical to SEQ ID NO: 68184
  Description of Artificial Sequence: Synthetic oligonucleotide

SEQ ID NO: 414968 - DNA, 30 bp, Artificial Sequence; identical to SEQ ID NO: 68185
  Description of Artificial Sequence: Synthetic oligonucleotide

SEQ ID NO: 414969 - DNA, 29 bp, Artificial Sequence
  Description of Artificial Sequence: Synthetic oligonucleotide
gctggaaacagttcctcggagtggagaag

SEQ ID NO: 414970 - DNA, 33 bp, Artificial Sequence; identical to SEQ ID NO: 68187
  Description of Artificial Sequence: Synthetic oligonucleotide

SEQ ID NO: 414971 - DNA, 34 bp, Artificial Sequence; identical to SEQ ID NO: 68188
  Description of Artificial Sequence: Synthetic oligonucleotide

SEQ ID NO: 414972 - DNA, 33 bp, Artificial Sequence; identical to SEQ ID NO: 68189
  Description of Artificial Sequence: Synthetic oligonucleotide

SEQ ID NO: 414973 - DNA, 33 bp, Artificial Sequence; identical to SEQ ID NO: 68190
  Description of Artificial Sequence: Synthetic oligonucleotide

SEQ ID NO: 414974 - DNA, 34 bp, Artificial Sequence; identical to SEQ ID NO: 68191
  Description of Artificial Sequence: Synthetic oligonucleotide

SEQ ID NO: 414975 - DNA, 33 bp, Artificial Sequence; identical to SEQ ID NO: 68192
  Description of Artificial Sequence: Synthetic oligonucleotide

SEQ ID NO: 414976 - DNA, 32 bp, Artificial Sequence; identical to SEQ ID NO: 68193
  Description of Artificial Sequence: Synthetic oligonucleotide

SEQ ID NO: 414977 - DNA, 31 bp, Artificial Sequence; identical to SEQ ID NO: 68194
  Description of Artificial Sequence: Synthetic oligonucleotide

SEQ ID NO: 414978 - DNA, 31 bp, Artificial Sequence; identical to SEQ ID NO: 68195
  Description of Artificial Sequence: Synthetic oligonucleotide

SEQ ID NO: 414979 - DNA, 30 bp, Artificial Sequence; identical to SEQ ID NO: 68196
  Description of Artificial Sequence: Synthetic oligonucleotide

SEQ ID NO: 414980 - DNA, 30 bp, Artificial Sequence; identical to SEQ ID NO: 68197
  Description of Artificial Sequence: Synthetic oligonucleotide

SEQ ID NO: 414981 - DNA, 29 bp, Artificial Sequence
  Description of Artificial Sequence: Synthetic oligonucleotide
tcctcggagtggagaagtttacacctgcc

SEQ ID NO: 414982 - DNA, 28 bp, Artificial Sequence
  Description of Artificial Sequence: Synthetic oligonucleotide
cctcggagtggagaagtttacacctgcc

SEQ ID NO: 414983 - DNA, 30 bp, Artificial Sequence; identical to SEQ ID NO: 68200
  Description of Artificial Sequence: Synthetic oligonucleotide

SEQ ID NO: 414984 - DNA, 31 bp, Artificial Sequence; identical to SEQ ID NO: 68201
  Description of Artificial Sequence: Synthetic oligonucleotide

SEQ ID NO: 414985 - DNA, 30 bp, Artificial Sequence; identical to SEQ ID NO: 68202
  Description of Artificial Sequence: Synthetic oligonucleotide

SEQ ID NO: 414986 - DNA, 30 bp, Artificial Sequence; identical to SEQ ID NO: 68203
  Description of Artificial Sequence: Synthetic oligonucleotide

SEQ ID NO: 414987 - DNA, 31 bp, Artificial Sequence; identical to SEQ ID NO: 68204
  Description of Artificial Sequence: Synthetic oligonucleotide

SEQ ID NO: 414988 - DNA, 31 bp, Artificial Sequence; identical to SEQ ID NO: 68205
  Description of Artificial Sequence: Synthetic oligonucleotide

SEQ ID NO: 414989 - DNA, 30 bp, Artificial Sequence; identical to SEQ ID NO: 68206
  Description of Artificial Sequence: Synthetic oligonucleotide

SEQ ID NO: 414990 - DNA, 31 bp, Artificial Sequence; identical to SEQ ID NO: 68207
  Description of Artificial Sequence: Synthetic oligonucleotide

SEQ ID NO: 414991 - DNA, 30 bp, Artificial Sequence; identical to SEQ ID NO: 68208
  Description of Artificial Sequence: Synthetic oligonucleotide

SEQ ID NO: 414992 - DNA, 30 bp, Artificial Sequence; identical to SEQ ID NO: 68209
  Description of Artificial Sequence: Synthetic oligonucleotide

SEQ ID NO: 414993 - DNA, 30 bp, Artificial Sequence; identical to SEQ ID NO: 68210
  Description of Artificial Sequence: Synthetic oligonucleotide

SEQ ID NO: 414994 - DNA, 29 bp, Artificial Sequence
  Description of Artificial Sequence: Synthetic oligonucleotide
gaagtttacacctgccaagtggagcaccc

SEQ ID NO: 414995 - DNA, 31 bp, Artificial Sequence; identical to SEQ ID NO: 68212
  Description of Artificial Sequence: Synthetic oligonucleotide

SEQ ID NO: 414996 - DNA, 30 bp, Artificial Sequence; identical to SEQ ID NO: 68213
  Description of Artificial Sequence: Synthetic oligonucleotide

SEQ ID NO: 414997 - DNA, 28 bp, Artificial Sequence
  Description of Artificial Sequence: Synthetic oligonucleotide
ctgccaagtggagcacccaagtgtgatg

SEQ ID NO: 414998 - DNA, 29 bp, Artificial Sequence
  Description of Artificial Sequence: Synthetic oligonucleotide
tgccaagtggagcacccaagtgtgatgag

SEQ ID NO: 414999 - DNA, 28 bp, Artificial Sequence
  Description of Artificial Sequence: Synthetic oligonucleotide
gccaagtggagcacccaagtgtgatgag

SEQ ID NO: 415000 - DNA, 28 bp, Artificial Sequence
  Description of Artificial Sequence: Synthetic oligonucleotide
ccaagtggagcacccaagtgtgatgagc

SEQ ID NO: 415001 - DNA, 28 bp, Artificial Sequence
  Description of Artificial Sequence: Synthetic oligonucleotide
caagtggagcacccaagtgtgatgagcc

SEQ ID NO: 415002 - DNA, 28 bp, Artificial Sequence
  Description of Artificial Sequence: Synthetic oligonucleotide
aagtggagcacccaagtgtgatgagccc

SEQ ID NO: 415003 - DNA, 27 bp, Artificial Sequence
  Description of Artificial Sequence: Synthetic oligonucleotide
agtggagcacccaagtgtgatgagccc

SEQ ID NO: 415004 - DNA, 27 bp, Artificial Sequence
  Description of Artificial Sequence: Synthetic oligonucleotide
gtggagcacccaagtgtgatgagccct

SEQ ID NO: 415005 - DNA, 27 bp, Artificial Sequence
  Description of Artificial Sequence: Synthetic oligonucleotide
tggagcacccaagtgtgatgagccctc

SEQ ID NO: 415006 - DNA, 27 bp, Artificial Sequence
  Description of Artificial Sequence: Synthetic oligonucleotide
ggagcacccaagtgtgatgagccctct

SEQ ID NO: 415007 - DNA, 27 bp, Artificial Sequence
  Description of Artificial Sequence: Synthetic oligonucleotide
gagcacccaagtgtgatgagccctctc

SEQ ID NO: 415008 - DNA, 28 bp, Artificial Sequence
  Description of Artificial Sequence: Synthetic oligonucleotide
agcacccaagtgtgatgagccctctcac

SEQ ID NO: 415009 - DNA, 27 bp, Artificial Sequence
  Description of Artificial Sequence: Synthetic oligonucleotide
gcacccaagtgtgatgagccctctcac

SEQ ID NO: 415010 - DNA, 28 bp, Artificial Sequence
  Description of Artificial Sequence: Synthetic oligonucleotide
cacccaagtgtgatgagccctctcacag

SEQ ID NO: 415011 - DNA, 29 bp, Artificial Sequence
  Description of Artificial Sequence: Synthetic oligonucleotide
acccaagtgtgatgagccctctcacagtg

SEQ ID NO: 415012 - DNA, 28 bp, Artificial Sequence
  Description of Artificial Sequence: Synthetic oligonucleotide
cccaagtgtgatgagccctctcacagtg

SEQ ID NO: 415013 - DNA, 28 bp, Artificial Sequence
  Description of Artificial Sequence: Synthetic oligonucleotide
ccaagtgtgatgagccctctcacagtgg

SEQ ID NO: 415014 - DNA, 31 bp, Artificial Sequence; identical to SEQ ID NO: 68231
  Description of Artificial Sequence: Synthetic oligonucleotide

SEQ ID NO: 415015 - DNA, 31 bp, Artificial Sequence; identical to SEQ ID NO: 68232
  Description of Artificial Sequence: Synthetic oligonucleotide

SEQ ID NO: 415016 - DNA, 30 bp, Artificial Sequence; identical to SEQ ID NO: 68233
  Description of Artificial Sequence: Synthetic oligonucleotide

SEQ ID NO: 415017 - DNA, 29 bp, Artificial Sequence
  Description of Artificial Sequence: Synthetic oligonucleotide
gtgtgatgagccctctcacagtggaatgg

SEQ ID NO: 415018 - DNA, 30 bp, Artificial Sequence; identical to SEQ ID NO: 68235
  Description of Artificial Sequence: Synthetic oligonucleotide

SEQ ID NO: 415019 - DNA, 29 bp, Artificial Sequence
  Description of Artificial Sequence: Synthetic oligonucleotide
gtgatgagccctctcacagtggaatggag

SEQ ID NO: 415020 - DNA, 30 bp, Artificial Sequence; identical to SEQ ID NO: 68237
  Description of Artificial Sequence: Synthetic oligonucleotide

SEQ ID NO: 415021 - DNA, 29 bp, Artificial Sequence
  Description of Artificial Sequence: Synthetic oligonucleotide
gatgagccctctcacagtggaatggagag

SEQ ID NO: 415022 - DNA, 29 bp, Artificial Sequence
  Description of Artificial Sequence: Synthetic oligonucleotide
atgagccctctcacagtggaatggagagc

SEQ ID NO: 415023 - DNA, 28 bp, Artificial Sequence
  Description of Artificial Sequence: Synthetic oligonucleotide
tgagccctctcacagtggaatggagagc

SEQ ID NO: 415024 - DNA, 24 bp, Artificial Sequence
  Description of Artificial Sequence: Synthetic oligonucleotide
cctgctcttccttggggccgggtt

SEQ ID NO: 415025 - DNA, 26 bp, Artificial Sequence
  Description of Artificial Sequence: Synthetic oligonucleotide
ctgctcttccttggggccgggttgtt

SEQ ID NO: 415026 - DNA, 27 bp, Artificial Sequence
  Description of Artificial Sequence: Synthetic oligonucleotide
tgctcttccttggggccgggttgttca

SEQ ID NO: 415027 - DNA, 27 bp, Artificial Sequence
  Description of Artificial Sequence: Synthetic oligonucleotide
gctcttccttggggccgggttgttcat

SEQ ID NO: 415028 - DNA, 27 bp, Artificial Sequence
  Description of Artificial Sequence: Synthetic oligonucleotide
ctcttccttggggccgggttgttcatc

SEQ ID NO: 415029 - DNA, 29 bp, Artificial Sequence
  Description of Artificial Sequence: Synthetic oligonucleotide
tcttccttggggccgggttgttcatctac

SEQ ID NO: 415030 - DNA, 28 bp, Artificial Sequence
  Description of Artificial Sequence: Synthetic oligonucleotide
cttccttggggccgggttgttcatctac

SEQ ID NO: 415031 - DNA, 30 bp, Artificial Sequence; identical to SEQ ID NO: 68248
  Description of Artificial Sequence: Synthetic oligonucleotide

SEQ ID NO: 415032 - DNA, 29 bp, Artificial Sequence
  Description of Artificial Sequence: Synthetic oligonucleotide
tccttggggccgggttgttcatctacttc

SEQ ID NO: 415033 - DNA, 28 bp, Artificial Sequence
  Description of Artificial Sequence: Synthetic oligonucleotide
ccttggggccgggttgttcatctacttc

SEQ ID NO: 415034 - DNA, 29 bp, Artificial Sequence
  Description of Artificial Sequence: Synthetic oligonucleotide
cttggggccgggttgttcatctacttcag

SEQ ID NO: 415035 - DNA, 29 bp, Artificial Sequence
  Description of Artificial Sequence: Synthetic oligonucleotide
ttggggccgggttgttcatctacttcagg

SEQ ID NO: 415036 - DNA, 28 bp, Artificial Sequence
  Description of Artificial Sequence: Synthetic oligonucleotide
tggggccgggttgttcatctacttcagg

SEQ ID NO: 415037 - DNA, 27 bp, Artificial Sequence
  Description of Artificial Sequence: Synthetic oligonucleotide
ggggccgggttgttcatctacttcagg

SEQ ID NO: 415038 - DNA, 30 bp, Artificial Sequence; identical to SEQ ID NO: 68255
  Description of Artificial Sequence: Synthetic oligonucleotide

SEQ ID NO: 415039 - DNA, 31 bp, Artificial Sequence; identical to SEQ ID NO: 68256
  Description of Artificial Sequence: Synthetic oligonucleotide

SEQ ID NO: 415040 - DNA, 34 bp, Artificial Sequence; identical to SEQ ID NO: 68257
  Description of Artificial Sequence: Synthetic oligonucleotide

SEQ ID NO: 415041 - DNA, 34 bp, Artificial Sequence; identical to SEQ ID NO: 68258
  Description of Artificial Sequence: Synthetic oligonucleotide

SEQ ID NO: 415042 - DNA, 35 bp, Artificial Sequence; identical to SEQ ID NO: 68259
  Description of Artificial Sequence: Synthetic oligonucleotide

SEQ ID NO: 415043 - DNA, 36 bp, Artificial Sequence; identical to SEQ ID NO: 68260
  Description of Artificial Sequence: Synthetic oligonucleotide

SEQ ID NO: 415044 - DNA, 37 bp, Artificial Sequence; identical to SEQ ID NO: 68261
  Description of Artificial Sequence: Synthetic oligonucleotide

SEQ ID NO: 415045 - DNA, 38 bp, Artificial Sequence; identical to SEQ ID NO: 68262
  Description of Artificial Sequence: Synthetic oligonucleotide

SEQ ID NO: 415046 - DNA, 38 bp, Artificial Sequence; identical to SEQ ID NO: 68263
  Description of Artificial Sequence: Synthetic oligonucleotide

SEQ ID NO: 415047 - DNA, 38 bp, Artificial Sequence; identical to SEQ ID NO: 68264
  Description of Artificial Sequence: Synthetic oligonucleotide

SEQ ID NO: 415048 - DNA, 40 bp, Artificial Sequence; identical to SEQ ID NO: 68265
  Description of Artificial Sequence: Synthetic oligonucleotide

SEQ ID NO: 415049 - DNA, 39 bp, Artificial Sequence; identical to SEQ ID NO: 68266
  Description of Artificial Sequence: Synthetic oligonucleotide

SEQ ID NO: 415050 - DNA, 41 bp, Artificial Sequence; identical to SEQ ID NO: 68267
  Description of Artificial Sequence: Synthetic oligonucleotide

SEQ ID NO: 415051 - DNA, 41 bp, Artificial Sequence; identical to SEQ ID NO: 68268
  Description of Artificial Sequence: Synthetic oligonucleotide

SEQ ID NO: 415052 - DNA, 40 bp, Artificial Sequence; identical to SEQ ID NO: 68269
  Description of Artificial Sequence: Synthetic oligonucleotide

SEQ ID NO: 415053 - DNA, 39 bp, Artificial Sequence; identical to SEQ ID NO: 68270
  Description of Artificial Sequence: Synthetic oligonucleotide

SEQ ID NO: 415054 - DNA, 38 bp, Artificial Sequence; identical to SEQ ID NO: 68271
  Description of Artificial Sequence: Synthetic oligonucleotide

SEQ ID NO: 415055 - DNA, 38 bp, Artificial Sequence; identical to SEQ ID NO: 68272
  Description of Artificial Sequence: Synthetic oligonucleotide

SEQ ID NO: 415056 - DNA, 38 bp, Artificial Sequence; identical to SEQ ID NO: 68273
  Description of Artificial Sequence: Synthetic oligonucleotide

SEQ ID NO: 415057 - DNA, 37 bp, Artificial Sequence; identical to SEQ ID NO: 68274
  Description of Artificial Sequence: Synthetic oligonucleotide

SEQ ID NO: 415058 - DNA, 38 bp, Artificial Sequence; identical to SEQ ID NO: 68275
  Description of Artificial Sequence: Synthetic oligonucleotide

SEQ ID NO: 415059 - DNA, 37 bp, Artificial Sequence; identical to SEQ ID NO: 68276
  Description of Artificial Sequence: Synthetic oligonucleotide

SEQ ID NO: 415060 - DNA, 37 bp, Artificial Sequence; identical to SEQ ID NO: 68277
  Description of Artificial Sequence: Synthetic oligonucleotide

SEQ ID NO: 415061 - DNA, 37 bp, Artificial Sequence; identical to SEQ ID NO: 68278
  Description of Artificial Sequence: Synthetic oligonucleotide

SEQ ID NO: 415062 - DNA, 38 bp, Artificial Sequence; identical to SEQ ID NO: 68279
  Description of Artificial Sequence: Synthetic oligonucleotide

SEQ ID NO: 415063 - DNA, 37 bp, Artificial Sequence; identical to SEQ ID NO: 68280
  Description of Artificial Sequence: Synthetic oligonucleotide

SEQ ID NO: 415064 - DNA, 37 bp, Artificial Sequence; identical to SEQ ID NO: 68281
  Description of Artificial Sequence: Synthetic oligonucleotide

SEQ ID NO: 415065 - DNA, 37 bp, Artificial Sequence; identical to SEQ ID NO: 68282
  Description of Artificial Sequence: Synthetic oligonucleotide

SEQ ID NO: 415066 - DNA, 37 bp, Artificial Sequence; identical to SEQ ID NO: 68283
  Description of Artificial Sequence: Synthetic oligonucleotide

SEQ ID NO: 415067 - DNA, 36 bp, Artificial Sequence; identical to SEQ ID NO: 68284
  Description of Artificial Sequence: Synthetic oligonucleotide

SEQ ID NO: 415068 - DNA, 35 bp, Artificial Sequence; identical to SEQ ID NO: 68285
  Description of Artificial Sequence: Synthetic oligonucleotide

SEQ ID NO: 415069 - DNA, 34 bp, Artificial Sequence; identical to SEQ ID NO: 68286
  Description of Artificial Sequence: Synthetic oligonucleotide

SEQ ID NO: 415070 - DNA, 37 bp, Artificial Sequence; identical to SEQ ID NO: 68287
  Description of Artificial Sequence: Synthetic oligonucleotide

SEQ ID NO: 415071 - DNA, 37 bp, Artificial Sequence; identical to SEQ ID NO: 68288
  Description of Artificial Sequence: Synthetic oligonucleotide

SEQ ID NO: 415072 - DNA, 36 bp, Artificial Sequence; identical to SEQ ID NO: 68289
  Description of Artificial Sequence: Synthetic oligonucleotide

SEQ ID NO: 415073 - DNA, 35 bp, Artificial Sequence; identical to SEQ ID NO: 68290
  Description of Artificial Sequence: Synthetic oligonucleotide

SEQ ID NO: 415074 - DNA, 34 bp, Artificial Sequence; identical to SEQ ID NO: 68291
  Description of Artificial Sequence: Synthetic oligonucleotide

SEQ ID NO: 415075 - DNA, 34 bp, Artificial Sequence; identical to SEQ ID NO: 68292
  Description of Artificial Sequence: Synthetic oligonucleotide

SEQ ID NO: 415076 - DNA, 33 bp, Artificial Sequence; identical to SEQ ID NO: 68293
  Description of Artificial Sequence: Synthetic oligonucleotide

SEQ ID NO: 415077 - DNA, 32 bp, Artificial Sequence; identical to SEQ ID NO: 68294
  Description of Artificial Sequence: Synthetic oligonucleotide

SEQ ID NO: 415078 - DNA, 31 bp, Artificial Sequence; identical to SEQ ID NO: 68295
  Description of Artificial Sequence: Synthetic oligonucleotide

SEQ ID NO: 415079 - DNA, 29 bp, Artificial Sequence
  Description of Artificial Sequence: Synthetic oligonucleotide
atttcttcaacgggacggagagggtgcag

SEQ ID NO: 415080 - DNA, 28 bp, Artificial Sequence
  Description of Artificial Sequence: Synthetic oligonucleotide
tttcttcaacgggacggagagggtgcag

SEQ ID NO: 415081 - DNA, 27 bp, Artificial Sequence
  Description of Artificial Sequence: Synthetic oligonucleotide
ttcttcaacgggacggagagggtgcag

SEQ ID NO: 415082 - DNA, 27 bp, Artificial Sequence
  Description of Artificial Sequence: Synthetic oligonucleotide
tcttcaacgggacggagagggtgcagt

SEQ ID NO: 415083 - DNA, 27 bp, Artificial Sequence
  Description of Artificial Sequence: Synthetic oligonucleotide
cttcaacgggacggagagggtgcagtt

SEQ ID NO: 415084 - DNA, 27 bp, Artificial Sequence
  Description of Artificial Sequence: Synthetic oligonucleotide
ttcaacgggacggagagggtgcagttc

SEQ ID NO: 415085 - DNA, 26 bp, Artificial Sequence
  Description of Artificial Sequence: Synthetic oligonucleotide
tcaacgggacggagagggtgcagttc

SEQ ID NO: 415086 - DNA, 25 bp, Artificial Sequence
  Description of Artificial Sequence: Synthetic oligonucleotide
caacgggacggagagggtgcagttc

SEQ ID NO: 415087 - DNA, 26 bp, Artificial Sequence
  Description of Artificial Sequence: Synthetic oligonucleotide
aacgggacggagagggtgcagttcct

SEQ ID NO: 415088 - DNA, 25 bp, Artificial Sequence
  Description of Artificial Sequence: Synthetic oligonucleotide
acgggacggagagggtgcagttcct

SEQ ID NO: 415089 - DNA, 24 bp, Artificial Sequence
  Description of Artificial Sequence: Synthetic oligonucleotide
cgggacggagagggtgcagttcct

SEQ ID NO: 415090 - DNA, 24 bp, Artificial Sequence
  Description of Artificial Sequence: Synthetic oligonucleotide
gggacggagagggtgcagttcctg

SEQ ID NO: 415091 - DNA, 27 bp, Artificial Sequence
  Description of Artificial Sequence: Synthetic oligonucleotide
ggacggagagggtgcagttcctggaaa

SEQ ID NO: 415092 - DNA, 27 bp, Artificial Sequence
  Description of Artificial Sequence: Synthetic oligonucleotide
gacggagagggtgcagttcctggaaag

SEQ ID NO: 415093 - DNA, 28 bp, Artificial Sequence
  Description of Artificial Sequence: Synthetic oligonucleotide
acggagagggtgcagttcctggaaagac

SEQ ID NO: 415094 - DNA, 27 bp, Artificial Sequence
  Description of Artificial Sequence: Synthetic oligonucleotide
cggagagggtgcagttcctggaaagac

SEQ ID NO: 415095 - DNA, 28 bp, Artificial Sequence
  Description of Artificial Sequence: Synthetic oligonucleotide
ggagagggtgcagttcctggaaagactc

SEQ ID NO: 415096 - DNA, 30 bp, Artificial Sequence; identical to SEQ ID NO: 68313
  Description of Artificial Sequence: Synthetic oligonucleotide

SEQ ID NO: 415097 - DNA, 35 bp, Artificial Sequence; identical to SEQ ID NO: 68314
  Description of Artificial Sequence: Synthetic oligonucleotide

SEQ ID NO: 415098 - DNA, 34 bp, Artificial Sequence; identical to SEQ ID NO: 68315
  Description of Artificial Sequence: Synthetic oligonucleotide

SEQ ID NO: 415099 - DNA, 34 bp, Artificial Sequence; identical to SEQ ID NO: 68316
  Description of Artificial Sequence: Synthetic oligonucleotide

SEQ ID NO: 415100 - DNA, 30 bp, Artificial Sequence
  Description of Artificial Sequence: Synthetic oligonucleotide
aggtggacaccgtgtgcagacacaactatg

SEQ ID NO: 415101 - DNA, 29 bp, Artificial Sequence
  Description of Artificial Sequence: Synthetic oligonucleotide
ggtggacaccgtgtgcagacacaactatg

SEQ ID NO: 415102 - DNA, 29 bp, Artificial Sequence
  Description of Artificial Sequence: Synthetic oligonucleotide
gtggacaccgtgtgcagacacaactatgg

SEQ ID NO: 415103 - DNA, 29 bp, Artificial Sequence
  Description of Artificial Sequence: Synthetic oligonucleotide
tggacaccgtgtgcagacacaactatggg

SEQ ID NO: 415104 - DNA, 28 bp, Artificial Sequence
  Description of Artificial Sequence: Synthetic oligonucleotide
ggacaccgtgtgcagacacaactatggg

SEQ ID NO: 415105 - DNA, 28 bp, Artificial Sequence
  Description of Artificial Sequence: Synthetic oligonucleotide
gacaccgtgtgcagacacaactatgggg

SEQ ID NO: 415106 - DNA, 30 bp, Artificial Sequence
  Description of Artificial Sequence: Synthetic oligonucleotide
acaccgtgtgcagacacaactatggggttg

SEQ ID NO: 415107 - DNA, 29 bp, Artificial Sequence
  Description of Artificial Sequence: Synthetic oligonucleotide
caccgtgtgcagacacaactatggggttg

SEQ ID NO: 415108 - DNA, 29 bp, Artificial Sequence
  Description of Artificial Sequence: Synthetic oligonucleotide
accgtgtgcagacacaactatggggttgg

SEQ ID NO: 415109 - DNA, 28 bp, Artificial Sequence
  Description of Artificial Sequence: Synthetic oligonucleotide
ccgtgtgcagacacaactatggggttgg

SEQ ID NO: 415110 - DNA, 29 bp, Artificial Sequence
  Description of Artificial Sequence: Synthetic oligonucleotide
cgtgtgcagacacaactatggggttggtg

SEQ ID NO: 415111 - DNA, 30 bp, Artificial Sequence
  Description of Artificial Sequence: Synthetic oligonucleotide
gtgtgcagacacaactatggggttggtgag

SEQ ID NO: 415112 - DNA, 31 bp, Artificial Sequence
  Description of Artificial Sequence: Synthetic oligonucleotide
tgtgcagacacaactatggggttggtgagag

SEQ ID NO: 415113 - DNA, 30 bp, Artificial Sequence
  Description of Artificial Sequence: Synthetic oligonucleotide
gtgcagacacaactatggggttggtgagag

SEQ ID NO: 415114 - DNA, 27 bp, Artificial Sequence
  Description of Artificial Sequence: Synthetic oligonucleotide
acggagcgggtgcagttcctggaaagt

SEQ ID NO: 415115 - DNA, 26 bp, Artificial Sequence
  Description of Artificial Sequence: Synthetic oligonucleotide
cggagcgggtgcagttcctggaaagt

SEQ ID NO: 415116 - DNA, 27 bp, Artificial Sequence
  Description of Artificial Sequence: Synthetic oligonucleotide
ggagcgggtgcagttcctggaaagtct

SEQ ID NO: 415117 - DNA, 27 bp, Artificial Sequence
  Description of Artificial Sequence: Synthetic oligonucleotide
gagcgggtgcagttcctggaaagtctc

SEQ ID NO: 415118 - DNA, 29 bp, Artificial Sequence
  Description of Artificial Sequence: Synthetic oligonucleotide
agcgggtgcagttcctggaaagtctcttc

SEQ ID NO: 415119 - DNA, 28 bp, Artificial Sequence
  Description of Artificial Sequence: Synthetic oligonucleotide
gcgggtgcagttcctggaaagtctcttc

SEQ ID NO: 415120 - DNA, 33 bp, Artificial Sequence; identical to SEQ ID NO: 68323
  Description of Artificial Sequence: Synthetic oligonucleotide

SEQ ID NO: 415121 - DNA, 33 bp, Artificial Sequence; identical to SEQ ID NO: 68324
  Description of Artificial Sequence: Synthetic oligonucleotide

SEQ ID NO: 415122 - DNA, 34 bp, Artificial Sequence; identical to SEQ ID NO: 68325
  Description of Artificial Sequence: Synthetic oligonucleotide

SEQ ID NO: 415123 - DNA, 34 bp, Artificial Sequence; identical to SEQ ID NO: 68326
  Description of Artificial Sequence: Synthetic oligonucleotide

SEQ ID NO: 415124 - DNA, 35 bp, Artificial Sequence; identical to SEQ ID NO: 68327
  Description of Artificial Sequence: Synthetic oligonucleotide

SEQ ID NO: 415125 - DNA, 34 bp, Artificial Sequence; identical to SEQ ID NO: 68328
  Description of Artificial Sequence: Synthetic oligonucleotide

SEQ ID NO: 415126 - DNA, 34 bp, Artificial Sequence; identical to SEQ ID NO: 68329
  Description of Artificial Sequence: Synthetic oligonucleotide

SEQ ID NO: 415127 - DNA, 35 bp, Artificial Sequence; identical to SEQ ID NO: 68330
  Description of Artificial Sequence: Synthetic oligonucleotide

SEQ ID NO: 415128 - DNA, 34 bp, Artificial Sequence; identical to SEQ ID NO: 68331
  Description of Artificial Sequence: Synthetic oligonucleotide

SEQ ID NO: 415129 - DNA, 36 bp, Artificial Sequence; identical to SEQ ID NO: 68332
  Description of Artificial Sequence: Synthetic oligonucleotide

SEQ ID NO: 415130 - DNA, 35 bp, Artificial Sequence; identical to SEQ ID NO: 68333
  Description of Artificial Sequence: Synthetic oligonucleotide

SEQ ID NO: 415131 - DNA, 34 bp, Artificial Sequence; identical to SEQ ID NO: 68334
  Description of Artificial Sequence: Synthetic oligonucleotide

SEQ ID NO: 415132 - DNA, 34 bp, Artificial Sequence; identical to SEQ ID NO: 68335
  Description of Artificial Sequence: Synthetic oligonucleotide

SEQ ID NO: 415133 - DNA, 35 bp, Artificial Sequence; identical to SEQ ID NO: 68336
  Description of Artificial Sequence: Synthetic oligonucleotide

SEQ ID NO: 415134 - DNA, 34 bp, Artificial Sequence; identical to SEQ ID NO: 68337
  Description of Artificial Sequence: Synthetic oligonucleotide

SEQ ID NO: 415135 - DNA, 34 bp, Artificial Sequence; identical to SEQ ID NO: 68338
  Description of Artificial Sequence: Synthetic oligonucleotide

SEQ ID NO: 415136 - DNA, 34 bp, Artificial Sequence; identical to SEQ ID NO: 68339
  Description of Artificial Sequence: Synthetic oligonucleotide

SEQ ID NO: 415137 - DNA, 33 bp, Artificial Sequence; identical to SEQ ID NO: 68340
  Description of Artificial Sequence: Synthetic oligonucleotide

SEQ ID NO: 415138 - DNA, 32 bp, Artificial Sequence; identical to SEQ ID NO: 68341
  Description of Artificial Sequence: Synthetic oligonucleotide

SEQ ID NO: 415139 - DNA, 31 bp, Artificial Sequence; identical to SEQ ID NO: 68342
  Description of Artificial Sequence: Synthetic oligonucleotide

SEQ ID NO: 415140 - DNA, 31 bp, Artificial Sequence; identical to SEQ ID NO: 68343
  Description of Artificial Sequence: Synthetic oligonucleotide

SEQ ID NO: 415141 - DNA, 26 bp, Artificial Sequence
  Description of Artificial Sequence: Synthetic oligonucleotide
gacaggcggggccaggtggacaatta

SEQ ID NO: 415142 - DNA, 27 bp, Artificial Sequence
  Description of Artificial Sequence: Synthetic oligonucleotide
acaggcggggccaggtggacaattact

SEQ ID NO: 415143 - DNA, 26 bp, Artificial Sequence
  Description of Artificial Sequence: Synthetic oligonucleotide
caggcggggccaggtggacaattact

SEQ ID NO: 415144 - DNA, 26 bp, Artificial Sequence
  Description of Artificial Sequence: Synthetic oligonucleotide
aggcggggccaggtggacaattactg

SEQ ID NO: 415145 - DNA, 25 bp, Artificial Sequence
  Description of Artificial Sequence: Synthetic oligonucleotide
ggcggggccaggtggacaattactg

SEQ ID NO: 415146 - DNA, 24 bp, Artificial Sequence
  Description of Artificial Sequence: Synthetic oligonucleotide
ctgtcgccgagtcctggaacagcc

SEQ ID NO: 415147 - DNA, 24 bp, Artificial Sequence
  Description of Artificial Sequence: Synthetic oligonucleotide
tgtcgccgagtcctggaacagccg

SEQ ID NO: 415148 - DNA, 23 bp, Artificial Sequence
  Description of Artificial Sequence: Synthetic oligonucleotide
gtcgccgagtcctggaacagccg

SEQ ID NO: 415149 - DNA, 25 bp, Artificial Sequence
  Description of Artificial Sequence: Synthetic oligonucleotide
tcgccgagtcctggaacagccggaa

SEQ ID NO: 415150 - DNA, 24 bp, Artificial Sequence
  Description of Artificial Sequence: Synthetic oligonucleotide
cgccgagtcctggaacagccggaa

SEQ ID NO: 415151 - DNA, 24 bp, Artificial Sequence
  Description of Artificial Sequence: Synthetic oligonucleotide
gccgagtcctggaacagccggaag

SEQ ID NO: 415152 - DNA, 25 bp, Artificial Sequence
  Description of Artificial Sequence: Synthetic oligonucleotide
ccgagtcctggaacagccggaagga

SEQ ID NO: 415153 - DNA, 27 bp, Artificial Sequence
  Description of Artificial Sequence: Synthetic oligonucleotide
cgagtcctggaacagccggaaggacat

SEQ ID NO: 415154 - DNA, 27 bp, Artificial Sequence
  Description of Artificial Sequence: Synthetic oligonucleotide
gagtcctggaacagccggaaggacatc

SEQ ID NO: 415155 - DNA, 27 bp, Artificial Sequence
  Description of Artificial Sequence: Synthetic oligonucleotide
agtcctggaacagccggaaggacatcc

SEQ ID NO: 415156 - DNA, 27 bp, Artificial Sequence
  Description of Artificial Sequence: Synthetic oligonucleotide
gtcctggaacagccggaaggacatcct

SEQ ID NO: 415157 - DNA, 27 bp, Artificial Sequence
  Description of Artificial Sequence: Synthetic oligonucleotide
tcctggaacagccggaaggacatcctg

SEQ ID NO: 415158 - DNA, 26 bp, Artificial Sequence
  Description of Artificial Sequence: Synthetic oligonucleotide
cctggaacagccggaaggacatcctg

SEQ ID NO: 415159 - DNA, 27 bp, Artificial Sequence
  Description of Artificial Sequence: Synthetic oligonucleotide
ctggaacagccggaaggacatcctgga

SEQ ID NO: 415160 - DNA, 27 bp, Artificial Sequence
  Description of Artificial Sequence: Synthetic oligonucleotide
tggaacagccggaaggacatcctggag

SEQ ID NO: 415161 - DNA, 26 bp, Artificial Sequence
  Description of Artificial Sequence: Synthetic oligonucleotide
ggaacagccggaaggacatcctggag

SEQ ID NO: 415162 - DNA, 27 bp, Artificial Sequence
  Description of Artificial Sequence: Synthetic oligonucleotide
gaacagccggaaggacatcctggagga

SEQ ID NO: 415163 - DNA, 27 bp, Artificial Sequence
  Description of Artificial Sequence: Synthetic oligonucleotide
aacagccggaaggacatcctggaggac

SEQ ID NO: 415164 - DNA, 27 bp, Artificial Sequence
  Description of Artificial Sequence: Synthetic oligonucleotide
acagccggaaggacatcctggaggaca

SEQ ID NO: 415165 - DNA, 26 bp, Artificial Sequence
  Description of Artificial Sequence: Synthetic oligonucleotide
cagccggaaggacatcctggaggaca

SEQ ID NO: 415166 - DNA, 26 bp, Artificial Sequence
  Description of Artificial Sequence: Synthetic oligonucleotide
agccggaaggacatcctggaggacag

SEQ ID NO: 415167 - DNA, 25 bp, Artificial Sequence
  Description of Artificial Sequence: Synthetic oligonucleotide
gccggaaggacatcctggaggacag

SEQ ID NO: 415168 - DNA, 25 bp, Artificial Sequence
  Description of Artificial Sequence: Synthetic oligonucleotide
ccggaaggacatcctggaggacagg

SEQ ID NO: 415169 - DNA, 25 bp, Artificial Sequence
  Description of Artificial Sequence: Synthetic oligonucleotide
cggaaggacatcctggaggacaggc

SEQ ID NO: 415170 - DNA, 25 bp, Artificial Sequence
  Description of Artificial Sequence: Synthetic oligonucleotide
ggaaggacatcctggaggacaggcg

SEQ ID NO: 415171 - DNA, 22 bp, Artificial Sequence
  Description of Artificial Sequence: Synthetic oligonucleotide
gtgacggagctagggcggcctg

SEQ ID NO: 415172 - DNA, 23 bp, Artificial Sequence
  Description of Artificial Sequence: Synthetic oligonucleotide
tgacggagctagggcggcctgct

SEQ ID NO: 415173 - DNA, 22 bp, Artificial Sequence
  Description of Artificial Sequence: Synthetic oligonucleotide
gacggagctagggcggcctgct

SEQ ID NO: 415174 - DNA, 22 bp, Artificial Sequence
  Description of Artificial Sequence: Synthetic oligonucleotide
acggagctagggcggcctgctg

SEQ ID NO: 415175 - DNA, 21 bp, Artificial Sequence
  Description of Artificial Sequence: Synthetic oligonucleotide
cggagctagggcggcctgctg

SEQ ID NO: 415176 - DNA, 21 bp, Artificial Sequence
  Description of Artificial Sequence: Synthetic oligonucleotide
ggagctagggcggcctgctgc

SEQ ID NO: 415177 - DNA, 21 bp, Artificial Sequence
  Description of Artificial Sequence: Synthetic oligonucleotide
gagctagggcggcctgctgcg

SEQ ID NO: 415178 - DNA, 22 bp, Artificial Sequence
  Description of Artificial Sequence: Synthetic oligonucleotide
agctagggcggcctgctgcgga

SEQ ID NO: 415179 - DNA, 21 bp, Artificial Sequence
  Description of Artificial Sequence: Synthetic oligonucleotide
gctagggcggcctgctgcgga

SEQ ID NO: 415180 - DNA, 23 bp, Artificial Sequence
  Description of Artificial Sequence: Synthetic oligonucleotide
ctagggcggcctgctgcggagta

SEQ ID NO: 415181 - DNA, 24 bp, Artificial Sequence
  Description of Artificial Sequence: Synthetic oligonucleotide
tagggcggcctgctgcggagtact

SEQ ID NO: 415182 - DNA, 23 bp, Artificial Sequence
  Description of Artificial Sequence: Synthetic oligonucleotide
agggcggcctgctgcggagtact

SEQ ID NO: 415183 - DNA, 22 bp, Artificial Sequence
  Description of Artificial Sequence: Synthetic oligonucleotide
cgggcggtgacggagctagggt

SEQ ID NO: 415184 - DNA, 22 bp, Artificial Sequence
  Description of Artificial Sequence: Synthetic oligonucleotide
gggcggtgacggagctagggtg

SEQ ID NO: 415185 - DNA, 22 bp, Artificial Sequence
  Description of Artificial Sequence: Synthetic oligonucleotide
ggcggtgacggagctagggtgg

SEQ ID NO: 415186 - DNA, 22 bp, Artificial Sequence
  Description of Artificial Sequence: Synthetic oligonucleotide
gcggtgacggagctagggtggc

SEQ ID NO: 415187 - DNA, 23 bp, Artificial Sequence
  Description of Artificial Sequence: Synthetic oligonucleotide
cggtgacggagctagggtggcct

SEQ ID NO: 415188 - DNA, 24 bp, Artificial Sequence
  Description of Artificial Sequence: Synthetic oligonucleotide
ggtgacggagctagggtggcctgt

SEQ ID NO: 415189 - DNA, 24 bp, Artificial Sequence
  Description of Artificial Sequence: Synthetic oligonucleotide
gtgacggagctagggtggcctgtc

SEQ ID NO: 415190 - DNA, 24 bp, Artificial Sequence
  Description of Artificial Sequence: Synthetic oligonucleotide
tgacggagctagggtggcctgtcg

SEQ ID NO: 415191 - DNA, 23 bp, Artificial Sequence
  Description of Artificial Sequence: Synthetic oligonucleotide
gacggagctagggtggcctgtcg

SEQ ID NO: 415192 - DNA, 23 bp, Artificial Sequence
  Description of Artificial Sequence: Synthetic oligonucleotide
acggagctagggtggcctgtcgc

SEQ ID NO: 415193 - DNA, 22 bp, Artificial Sequence
  Description of Artificial Sequence: Synthetic oligonucleotide
cggagctagggtggcctgtcgc

SEQ ID NO: 415194 - DNA, 22 bp, Artificial Sequence
  Description of Artificial Sequence: Synthetic oligonucleotide
ggagctagggtggcctgtcgcc

SEQ ID NO: 415195 - DNA, 23 bp, Artificial Sequence
  Description of Artificial Sequence: Synthetic oligonucleotide
gagctagggtggcctgtcgccga

SEQ ID NO: 415196 - DNA, 24 bp, Artificial Sequence
  Description of Artificial Sequence: Synthetic oligonucleotide
agctagggtggcctgtcgccgagt

SEQ ID NO: 415197 - DNA, 23 bp, Artificial Sequence
  Description of Artificial Sequence: Synthetic oligonucleotide
gctagggtggcctgtcgccgagt

SEQ ID NO: 415198 - DNA, 23 bp, Artificial Sequence
  Description of Artificial Sequence: Synthetic oligonucleotide
ctagggtggcctgtcgccgagtc

SEQ ID NO: 415199 - DNA, 24 bp, Artificial Sequence
  Description of Artificial Sequence: Synthetic oligonucleotide
tagggtggcctgtcgccgagtcct

SEQ ID NO: 415200 - DNA, 23 bp, Artificial Sequence
  Description of Artificial Sequence: Synthetic oligonucleotide
agggtggcctgtcgccgagtcct

SEQ ID NO: 415201 - DNA, 22 bp, Artificial Sequence
  Description of Artificial Sequence: Synthetic oligonucleotide
gggtggcctgtcgccgagtcct

SEQ ID NO: 415202 - DNA, 22 bp, Artificial Sequence
  Description of Artificial Sequence: Synthetic oligonucleotide
ggtggcctgtcgccgagtcctg

SEQ ID NO: 415203 - DNA, 24 bp, Artificial Sequence
  Description of Artificial Sequence: Synthetic oligonucleotide
gtggcctgtcgccgagtcctggaa

SEQ ID NO: 415204 - DNA, 25 bp, Artificial Sequence
  Description of Artificial Sequence: Synthetic oligonucleotide
tggcctgtcgccgagtcctggaaca

SEQ ID NO: 415205 - DNA, 34 bp, Artificial Sequence; identical to SEQ ID NO: 68408
  Description of Artificial Sequence: Synthetic oligonucleotide

SEQ ID NO: 415206 - DNA, 33 bp, Artificial Sequence; identical to SEQ ID NO: 68409
  Description of Artificial Sequence: Synthetic oligonucleotide

SEQ ID NO: 415207 - DNA, 32 bp, Artificial Sequence; identical to SEQ ID NO: 68410
  Description of Artificial Sequence: Synthetic oligonucleotide

SEQ ID NO: 415208 - DNA, 33 bp, Artificial Sequence; identical to SEQ ID NO: 68411
  Description of Artificial Sequence: Synthetic oligonucleotide

SEQ ID NO: 415209 - DNA, 33 bp, Artificial Sequence; identical to SEQ ID NO: 68412
  Description of Artificial Sequence: Synthetic oligonucleotide

SEQ ID NO: 415210 - DNA, 32 bp, Artificial Sequence; identical to SEQ ID NO: 68413
  Description of Artificial Sequence: Synthetic oligonucleotide

SEQ ID NO: 415211 - DNA, 33 bp, Artificial Sequence; identical to SEQ ID NO: 68414
  Description of Artificial Sequence: Synthetic oligonucleotide

SEQ ID NO: 415212 - DNA, 33 bp, Artificial Sequence; identical to SEQ ID NO: 68415
  Description of Artificial Sequence: Synthetic oligonucleotide

SEQ ID NO: 415213 - DNA, 32 bp, Artificial Sequence; identical to SEQ ID NO: 68416
  Description of Artificial Sequence: Synthetic oligonucleotide

SEQ ID NO: 415214 - DNA, 31 bp, Artificial Sequence; identical to SEQ ID NO: 68417
  Description of Artificial Sequence: Synthetic oligonucleotide

SEQ ID NO: 415215 - DNA, 30 bp, Artificial Sequence; identical to SEQ ID NO: 68418
  Description of Artificial Sequence: Synthetic oligonucleotide

SEQ ID NO: 415216 - DNA, 30 bp, Artificial Sequence; identical to SEQ ID NO: 68419
  Description of Artificial Sequence: Synthetic oligonucleotide

SEQ ID NO: 415217 - DNA, 29 bp, Artificial Sequence
  Description of Artificial Sequence: Synthetic oligonucleotide
ctcttctataaccaggaggaggtcgtgcg

SEQ ID NO: 415218 - DNA, 29 bp, Artificial Sequence
  Description of Artificial Sequence: Synthetic oligonucleotide
tcttctataaccaggaggaggtcgtgcgc

SEQ ID NO: 415219 - DNA, 28 bp, Artificial Sequence
  Description of Artificial Sequence: Synthetic oligonucleotide
cttctataaccaggaggaggtcgtgcgc

SEQ ID NO: 415220 - DNA, 30 bp, Artificial Sequence; identical to SEQ ID NO: 68423
  Description of Artificial Sequence: Synthetic oligonucleotide

SEQ ID NO: 415221 - DNA, 29 bp, Artificial Sequence
  Description of Artificial Sequence: Synthetic oligonucleotide
tctataaccaggaggaggtcgtgcgcttc

SEQ ID NO: 415222 - DNA, 28 bp, Artificial Sequence
  Description of Artificial Sequence: Synthetic oligonucleotide
ctataaccaggaggaggtcgtgcgcttc

SEQ ID NO: 415223 - DNA, 28 bp, Artificial Sequence
  Description of Artificial Sequence: Synthetic oligonucleotide
tataaccaggaggaggtcgtgcgcttcg

SEQ ID NO: 415224 - DNA, 27 bp, Artificial Sequence
  Description of Artificial Sequence: Synthetic oligonucleotide
ataaccaggaggaggtcgtgcgcttcg

SEQ ID NO: 415225 - DNA, 27 bp, Artificial Sequence
  Description of Artificial Sequence: Synthetic oligonucleotide
taaccaggaggaggtcgtgcgcttcga

SEQ ID NO: 415226 - DNA, 26 bp, Artificial Sequence
  Description of Artificial Sequence: Synthetic oligonucleotide
aaccaggaggaggtcgtgcgcttcga

SEQ ID NO: 415227 - DNA, 25 bp, Artificial Sequence
  Description of Artificial Sequence: Synthetic oligonucleotide
accaggaggaggtcgtgcgcttcga

SEQ ID NO: 415228 - DNA, 24 bp, Artificial Sequence
  Description of Artificial Sequence: Synthetic oligonucleotide
ccaggaggaggtcgtgcgcttcga

SEQ ID NO: 415229 - DNA, 25 bp, Artificial Sequence
  Description of Artificial Sequence: Synthetic oligonucleotide
caggaggaggtcgtgcgcttcgaca

SEQ ID NO: 415230 - DNA, 25 bp, Artificial Sequence
  Description of Artificial Sequence: Synthetic oligonucleotide
aggaggaggtcgtgcgcttcgacag

SEQ ID NO: 415231 - DNA, 24 bp, Artificial Sequence
  Description of Artificial Sequence: Synthetic oligonucleotide
ggaggaggtcgtgcgcttcgacag

SEQ ID NO: 415232 - DNA, 24 bp, Artificial Sequence
  Description of Artificial Sequence: Synthetic oligonucleotide
gaggaggtcgtgcgcttcgacagc

SEQ ID NO: 415233 - DNA, 25 bp, Artificial Sequence
  Description of Artificial Sequence: Synthetic oligonucleotide
aggaggtcgtgcgcttcgacagcga

SEQ ID NO: 415234 - DNA, 24 bp, Artificial Sequence
  Description of Artificial Sequence: Synthetic oligonucleotide
ggaggtcgtgcgcttcgacagcga

SEQ ID NO: 415235 - DNA, 24 bp, Artificial Sequence
  Description of Artificial Sequence: Synthetic oligonucleotide
gaggtcgtgcgcttcgacagcgac

SEQ ID NO: 415236 - DNA, 25 bp, Artificial Sequence
  Description of Artificial Sequence: Synthetic oligonucleotide
aggtcgtgcgcttcgacagcgacgt

SEQ ID NO: 415237 - DNA, 24 bp, Artificial Sequence
  Description of Artificial Sequence: Synthetic oligonucleotide
ggtcgtgcgcttcgacagcgacgt

SEQ ID NO: 415238 - DNA, 24 bp, Artificial Sequence
  Description of Artificial Sequence: Synthetic oligonucleotide
gtcgtgcgcttcgacagcgacgtg

SEQ ID NO: 415239 - DNA, 27 bp, Artificial Sequence
  Description of Artificial Sequence: Synthetic oligonucleotide
cggagcgggtgcagttcctggaaagat

SEQ ID NO: 415240 - DNA, 28 bp, Artificial Sequence
  Description of Artificial Sequence: Synthetic oligonucleotide
ggagcgggtgcagttcctggaaagattc

SEQ ID NO: 415241 - DNA, 30 bp, Artificial Sequence; identical to SEQ ID NO: 68444
  Description of Artificial Sequence: Synthetic oligonucleotide

SEQ ID NO: 415242 - DNA, 35 bp, Artificial Sequence; identical to SEQ ID NO: 68445
  Description of Artificial Sequence: Synthetic oligonucleotide

SEQ ID NO: 415243 - DNA, 34 bp, Artificial Sequence; identical to SEQ ID NO: 68446
  Description of Artificial Sequence: Synthetic oligonucleotide

SEQ ID NO: 415244 - DNA, 34 bp, Artificial Sequence; identical to SEQ ID NO: 68447
  Description of Artificial Sequence: Synthetic oligonucleotide

SEQ ID NO: 415245 - DNA, 35 bp, Artificial Sequence; identical to SEQ ID NO: 68448
  Description of Artificial Sequence: Synthetic oligonucleotide

SEQ ID NO: 415246 - DNA, 35 bp, Artificial Sequence; identical to SEQ ID NO: 68449
  Description of Artificial Sequence: Synthetic oligonucleotide

SEQ ID NO: 415247 - DNA, 36 bp, Artificial Sequence; identical to SEQ ID NO: 68450
  Description of Artificial Sequence: Synthetic oligonucleotide

SEQ ID NO: 415248 - DNA, 36 bp, Artificial Sequence; identical to SEQ ID NO: 68451
  Description of Artificial Sequence: Synthetic oligonucleotide

SEQ ID NO: 415249 - DNA, 35 bp, Artificial Sequence; identical to SEQ ID NO: 68452
  Description of Artificial Sequence: Synthetic oligonucleotide

SEQ ID NO: 415250 - DNA, 36 bp, Artificial Sequence; identical to SEQ ID NO: 68453
  Description of Artificial Sequence: Synthetic oligonucleotide

SEQ ID NO: 415251 - DNA, 38 bp, Artificial Sequence; identical to SEQ ID NO: 68454
  Description of Artificial Sequence: Synthetic oligonucleotide

SEQ ID NO: 415252 - DNA, 37 bp, Artificial Sequence; identical to SEQ ID NO: 68455
  Description of Artificial Sequence: Synthetic oligonucleotide

SEQ ID NO: 415253 - DNA, 37 bp, Artificial Sequence; identical to SEQ ID NO: 68456
  Description of Artificial Sequence: Synthetic oligonucleotide

SEQ ID NO: 415254 - DNA, 36 bp, Artificial Sequence; identical to SEQ ID NO: 68457
  Description of Artificial Sequence: Synthetic oligonucleotide

SEQ ID NO: 415255 - DNA, 35 bp, Artificial Sequence; identical to SEQ ID NO: 68458
  Description of Artificial Sequence: Synthetic oligonucleotide

SEQ ID NO: 415256 - DNA, 36 bp, Artificial Sequence; identical to SEQ ID NO: 68459
  Description of Artificial Sequence: Synthetic oligonucleotide

SEQ ID NO: 415257 - DNA, 36 bp, Artificial Sequence; identical to SEQ ID NO: 68460
  Description of Artificial Sequence: Synthetic oligonucleotide

SEQ ID NO: 415258 - DNA, 35 bp, Artificial Sequence; identical to SEQ ID NO: 68461
  Description of Artificial Sequence: Synthetic oligonucleotide

SEQ ID NO: 415259 - DNA, 35 bp, Artificial Sequence; identical to SEQ ID NO: 68462
  Description of Artificial Sequence: Synthetic oligonucleotide

SEQ ID NO: 415260 - DNA, 35 bp, Artificial Sequence; identical to SEQ ID NO: 68463
  Description of Artificial Sequence: Synthetic oligonucleotide

SEQ ID NO: 415261 - DNA, 34 bp, Artificial Sequence; identical to SEQ ID NO: 68464
  Description of Artificial Sequence: Synthetic oligonucleotide

SEQ ID NO: 415262 - DNA, 33 bp, Artificial Sequence; identical to SEQ ID NO: 68465
  Description of Artificial Sequence: Synthetic oligonucleotide

SEQ ID NO: 415263 - DNA, 32 bp, Artificial Sequence; identical to SEQ ID NO: 68466
  Description of Artificial Sequence: Synthetic oligonucleotide

SEQ ID NO: 415264 - DNA, 34 bp, Artificial Sequence; identical to SEQ ID NO: 68467
  Description of Artificial Sequence: Synthetic oligonucleotide

SEQ ID NO: 415265 - DNA, 33 bp, Artificial Sequence; identical to SEQ ID NO: 68468
  Description of Artificial Sequence: Synthetic oligonucleotide

SEQ ID NO: 415266 - DNA, 23 bp, Artificial Sequence
  Description of Artificial Sequence: Synthetic oligonucleotide
aggcggggccaggtggacaccta

SEQ ID NO: 415267 - DNA, 22 bp, Artificial Sequence
  Description of Artificial Sequence: Synthetic oligonucleotide
ggcggggccaggtggacaccta

SEQ ID NO: 415268 - DNA, 23 bp, Artificial Sequence
  Description of Artificial Sequence: Synthetic oligonucleotide
gcggggccaggtggacacctact

SEQ ID NO: 415269 - DNA, 23 bp, Artificial Sequence
  Description of Artificial Sequence: Synthetic oligonucleotide
cggggccaggtggacacctactg

SEQ ID NO: 415270 - DNA, 24 bp, Artificial Sequence
  Description of Artificial Sequence: Synthetic oligonucleotide
ggggccaggtggacacctactgca

SEQ ID NO: 415271 - DNA, 25 bp, Artificial Sequence
  Description of Artificial Sequence: Synthetic oligonucleotide
gggccaggtggacacctactgcaga

SEQ ID NO: 415272 - DNA, 26 bp, Artificial Sequence
  Description of Artificial Sequence: Synthetic oligonucleotide
ggccaggtggacacctactgcagaca

SEQ ID NO: 415273 - DNA, 27 bp, Artificial Sequence
  Description of Artificial Sequence: Synthetic oligonucleotide
gccaggtggacacctactgcagacaca

SEQ ID NO: 415274 - DNA, 28 bp, Artificial Sequence
  Description of Artificial Sequence: Synthetic oligonucleotide
ccaggtggacacctactgcagacacaac

SEQ ID NO: 415275 - DNA, 30 bp, Artificial Sequence; identical to SEQ ID NO: 68502
  Description of Artificial Sequence: Synthetic oligonucleotide

SEQ ID NO: 415276 - DNA, 24 bp, Artificial Sequence
  Description of Artificial Sequence: Synthetic oligonucleotide
ggtgacggagctagggcggcctat

SEQ ID NO: 415277 - DNA, 24 bp, Artificial Sequence
  Description of Artificial Sequence: Synthetic oligonucleotide
gtgacggagctagggcggcctatc

SEQ ID NO: 415278 - DNA, 24 bp, Artificial Sequence
  Description of Artificial Sequence: Synthetic oligonucleotide
tgacggagctagggcggcctatcg

SEQ ID NO: 415279 - DNA, 23 bp, Artificial Sequence
  Description of Artificial Sequence: Synthetic oligonucleotide
gacggagctagggcggcctatcg

SEQ ID NO: 415280 - DNA, 23 bp, Artificial Sequence
  Description of Artificial Sequence: Synthetic oligonucleotide
acggagctagggcggcctatcgc

SEQ ID NO: 415281 - DNA, 22 bp, Artificial Sequence
  Description of Artificial Sequence: Synthetic oligonucleotide
cggagctagggcggcctatcgc

SEQ ID NO: 415282 - DNA, 22 bp, Artificial Sequence
  Description of Artificial Sequence: Synthetic oligonucleotide
ggagctagggcggcctatcgcc

SEQ ID NO: 415283 - DNA, 23 bp, Artificial Sequence
  Description of Artificial Sequence: Synthetic oligonucleotide
gagctagggcggcctatcgccga

SEQ ID NO: 415284 - DNA, 24 bp, Artificial Sequence
  Description of Artificial Sequence: Synthetic oligonucleotide
agctagggcggcctatcgccgagt

SEQ ID NO: 415285 - DNA, 23 bp, Artificial Sequence
  Description of Artificial Sequence: Synthetic oligonucleotide
gctagggcggcctatcgccgagt

SEQ ID NO: 415286 - DNA, 23 bp, Artificial Sequence
  Description of Artificial Sequence: Synthetic oligonucleotide
ctagggcggcctatcgccgagtc

SEQ ID NO: 415287 - DNA, 24 bp, Artificial Sequence
  Description of Artificial Sequence: Synthetic oligonucleotide
tagggcggcctatcgccgagtcct

SEQ ID NO: 415288 - DNA, 23 bp, Artificial Sequence
  Description of Artificial Sequence: Synthetic oligonucleotide
agggcggcctatcgccgagtcct

SEQ ID NO: 415289 - DNA, 22 bp, Artificial Sequence
  Description of Artificial Sequence: Synthetic oligonucleotide
gggcggcctatcgccgagtcct

SEQ ID NO: 415290 - DNA, 22 bp, Artificial Sequence
  Description of Artificial Sequence: Synthetic oligonucleotide
ggcggcctatcgccgagtcctg

SEQ ID NO: 415291 - DNA, 24 bp, Artificial Sequence
  Description of Artificial Sequence: Synthetic oligonucleotide
gcggcctatcgccgagtcctggaa

SEQ ID NO: 415292 - DNA, 25 bp, Artificial Sequence
  Description of Artificial Sequence: Synthetic oligonucleotide
cggcctatcgccgagtcctggaaca

SEQ ID NO: 415293 - DNA, 25 bp, Artificial Sequence
  Description of Artificial Sequence: Synthetic oligonucleotide
ggcctatcgccgagtcctggaacag

SEQ ID NO: 415294 - DNA, 25 bp, Artificial Sequence
  Description of Artificial Sequence: Synthetic oligonucleotide
gcctatcgccgagtcctggaacagc

SEQ ID NO: 415295 - DNA, 26 bp, Artificial Sequence
  Description of Artificial Sequence: Synthetic oligonucleotide
cctatcgccgagtcctggaacagcca

SEQ ID NO: 415296 - DNA, 27 bp, Artificial Sequence
  Description of Artificial Sequence: Synthetic oligonucleotide
ctatcgccgagtcctggaacagccaga

SEQ ID NO: 415297 - DNA, 28 bp, Artificial Sequence
  Description of Artificial Sequence: Synthetic oligonucleotide
tatcgccgagtcctggaacagccagaag

SEQ ID NO: 415298 - DNA, 27 bp, Artificial Sequence
  Description of Artificial Sequence: Synthetic oligonucleotide
atcgccgagtcctggaacagccagaag

SEQ ID NO: 415299 - DNA, 22 bp, Artificial Sequence
  Description of Artificial Sequence: Synthetic oligonucleotide
gggcggtgacggagctagggct

SEQ ID NO: 415300 - DNA, 22 bp, Artificial Sequence
  Description of Artificial Sequence: Synthetic oligonucleotide
ggcggtgacggagctagggctg

SEQ ID NO: 415301 - DNA, 22 bp, Artificial Sequence
  Description of Artificial Sequence: Synthetic oligonucleotide
gcggtgacggagctagggctgc

SEQ ID NO: 415302 - DNA, 23 bp, Artificial Sequence
  Description of Artificial Sequence: Synthetic oligonucleotide
cggtgacggagctagggctgcct

SEQ ID NO: 415303 - DNA, 24 bp, Artificial Sequence
  Description of Artificial Sequence: Synthetic oligonucleotide
ggtgacggagctagggctgcctgt

SEQ ID NO: 415304 - DNA, 24 bp, Artificial Sequence
  Description of Artificial Sequence: Synthetic oligonucleotide
gtgacggagctagggctgcctgtc

SEQ ID NO: 415305 - DNA, 24 bp, Artificial Sequence
  Description of Artificial Sequence: Synthetic oligonucleotide
tgacggagctagggctgcctgtcg

SEQ ID NO: 415306 - DNA, 23 bp, Artificial Sequence
  Description of Artificial Sequence: Synthetic oligonucleotide
gacggagctagggctgcctgtcg

SEQ ID NO: 415307 - DNA, 23 bp, Artificial Sequence
  Description of Artificial Sequence: Synthetic oligonucleotide
acggagctagggctgcctgtcgc

SEQ ID NO: 415308 - DNA, 22 bp, Artificial Sequence
  Description of Artificial Sequence: Synthetic oligonucleotide
cggagctagggctgcctgtcgc

SEQ ID NO: 415309 - DNA, 22 bp, Artificial Sequence
  Description of Artificial Sequence: Synthetic oligonucleotide
ggagctagggctgcctgtcgcc

SEQ ID NO: 415310 - DNA, 23 bp, Artificial Sequence
  Description of Artificial Sequence: Synthetic oligonucleotide
gagctagggctgcctgtcgccga

SEQ ID NO: 415311 - DNA, 24 bp, Artificial Sequence
  Description of Artificial Sequence: Synthetic oligonucleotide
agctagggctgcctgtcgccgagt

SEQ ID NO: 415312 - DNA, 23 bp, Artificial Sequence
  Description of Artificial Sequence: Synthetic oligonucleotide
gctagggctgcctgtcgccgagt

SEQ ID NO: 415313 - DNA, 23 bp, Artificial Sequence
  Description of Artificial Sequence: Synthetic oligonucleotide
ctagggctgcctgtcgccgagtc

SEQ ID NO: 415314 - DNA, 24 bp, Artificial Sequence
  Description of Artificial Sequence: Synthetic oligonucleotide
tagggctgcctgtcgccgagtcct

SEQ ID NO: 415315 - DNA, 23 bp, Artificial Sequence
  Description of Artificial Sequence: Synthetic oligonucleotide
agggctgcctgtcgccgagtcct

SEQ ID NO: 415316 - DNA, 22 bp, Artificial Sequence
  Description of Artificial Sequence: Synthetic oligonucleotide
gggctgcctgtcgccgagtcct

SEQ ID NO: 415317 - DNA, 22 bp, Artificial Sequence
  Description of Artificial Sequence: Synthetic oligonucleotide
ggctgcctgtcgccgagtcctg

SEQ ID NO: 415318 - DNA, 24 bp, Artificial Sequence
  Description of Artificial Sequence: Synthetic oligonucleotide
gctgcctgtcgccgagtcctggaa

SEQ ID NO: 415319 - DNA, 25 bp, Artificial Sequence
  Description of Artificial Sequence: Synthetic oligonucleotide
ctgcctgtcgccgagtcctggaaca

SEQ ID NO: 415320 - DNA, 25 bp, Artificial Sequence
  Description of Artificial Sequence: Synthetic oligonucleotide
tgcctgtcgccgagtcctggaacag

SEQ ID NO: 415321 - DNA, 34 bp, Artificial Sequence; identical to SEQ ID NO: 68548
  Description of Artificial Sequence: Synthetic oligonucleotide

SEQ ID NO: 415322 - DNA, 33 bp, Artificial Sequence; identical to SEQ ID NO: 68549
  Description of Artificial Sequence: Synthetic oligonucleotide

SEQ ID NO: 415323 - DNA, 33 bp, Artificial Sequence; identical to SEQ ID NO: 68550
  Description of Artificial Sequence: Synthetic oligonucleotide

SEQ ID NO: 415324 - DNA, 33 bp, Artificial Sequence; identical to SEQ ID NO: 68551
  Description of Artificial Sequence: Synthetic oligonucleotide

SEQ ID NO: 415325 - DNA, 32 bp, Artificial Sequence; identical to SEQ ID NO: 68552
  Description of Artificial Sequence: Synthetic oligonucleotide

SEQ ID NO: 415326 - DNA, 33 bp, Artificial Sequence; identical to SEQ ID NO: 68553
  Description of Artificial Sequence: Synthetic oligonucleotide

SEQ ID NO: 415327 - DNA, 32 bp, Artificial Sequence; identical to SEQ ID NO: 68554
  Description of Artificial Sequence: Synthetic oligonucleotide

SEQ ID NO: 415328 - DNA, 31 bp, Artificial Sequence; identical to SEQ ID NO: 68555
  Description of Artificial Sequence: Synthetic oligonucleotide

SEQ ID NO: 415329 - DNA, 33 bp, Artificial Sequence; identical to SEQ ID NO: 68556
  Description of Artificial Sequence: Synthetic oligonucleotide

SEQ ID NO: 415330 - DNA, 33 bp, Artificial Sequence; identical to SEQ ID NO: 68557
  Description of Artificial Sequence: Synthetic oligonucleotide

SEQ ID NO: 415331 - DNA, 32 bp, Artificial Sequence; identical to SEQ ID NO: 68558
  Description of Artificial Sequence: Synthetic oligonucleotide

SEQ ID NO: 415332 - DNA, 33 bp, Artificial Sequence; identical to SEQ ID NO: 68559
  Description of Artificial Sequence: Synthetic oligonucleotide

SEQ ID NO: 415333 - DNA, 33 bp, Artificial Sequence; identical to SEQ ID NO: 68560
  Description of Artificial Sequence: Synthetic oligonucleotide

SEQ ID NO: 415334 - DNA, 32 bp, Artificial Sequence; identical to SEQ ID NO: 68561
  Description of Artificial Sequence: Synthetic oligonucleotide

SEQ ID NO: 415335 - DNA, 31 bp, Artificial Sequence; identical to SEQ ID NO: 68562
  Description of Artificial Sequence: Synthetic oligonucleotide

SEQ ID NO: 415336 - DNA, 30 bp, Artificial Sequence; identical to SEQ ID NO: 68563
  Description of Artificial Sequence: Synthetic oligonucleotide

SEQ ID NO: 415337 - DNA, 30 bp, Artificial Sequence; identical to SEQ ID NO: 68564
  Description of Artificial Sequence: Synthetic oligonucleotide

SEQ ID NO: 415338 - DNA, 29 bp, Artificial Sequence
  Description of Artificial Sequence: Synthetic oligonucleotide
ctcttctataaccagggggagttcgtgcg

SEQ ID NO: 415339 - DNA, 29 bp, Artificial Sequence
  Description of Artificial Sequence: Synthetic oligonucleotide
tcttctataaccagggggagttcgtgcgc

SEQ ID NO: 415340 - DNA, 28 bp, Artificial Sequence
  Description of Artificial Sequence: Synthetic oligonucleotide
cttctataaccagggggagttcgtgcgc

SEQ ID NO: 415341 - DNA, 30 bp, Artificial Sequence; identical to SEQ ID NO: 68568
  Description of Artificial Sequence: Synthetic oligonucleotide

SEQ ID NO: 415342 - DNA, 29 bp, Artificial Sequence
  Description of Artificial Sequence: Synthetic oligonucleotide
tctataaccagggggagttcgtgcgcttc

SEQ ID NO: 415343 - DNA, 28 bp, Artificial Sequence
  Description of Artificial Sequence: Synthetic oligonucleotide
ctataaccagggggagttcgtgcgcttc

SEQ ID NO: 415344 - DNA, 28 bp, Artificial Sequence
  Description of Artificial Sequence: Synthetic oligonucleotide
tataaccagggggagttcgtgcgcttcg

SEQ ID NO: 415345 - DNA, 27 bp, Artificial Sequence
  Description of Artificial Sequence: Synthetic oligonucleotide
ataaccagggggagttcgtgcgcttcg

SEQ ID NO: 415346 - DNA, 27 bp, Artificial Sequence
  Description of Artificial Sequence: Synthetic oligonucleotide
taaccagggggagttcgtgcgcttcga

SEQ ID NO: 415347 - DNA, 26 bp, Artificial Sequence
  Description of Artificial Sequence: Synthetic oligonucleotide
aaccagggggagttcgtgcgcttcga

SEQ ID NO: 415348 - DNA, 25 bp, Artificial Sequence
  Description of Artificial Sequence: Synthetic oligonucleotide
accagggggagttcgtgcgcttcga

SEQ ID NO: 415349 - DNA, 24 bp, Artificial Sequence
  Description of Artificial Sequence: Synthetic oligonucleotide
ccagggggagttcgtgcgcttcga

SEQ ID NO: 415350 - DNA, 25 bp, Artificial Sequence
  Description of Artificial Sequence: Synthetic oligonucleotide
cagggggagttcgtgcgcttcgaca

SEQ ID NO: 415351 - DNA, 25 bp, Artificial Sequence
  Description of Artificial Sequence: Synthetic oligonucleotide
agggggagttcgtgcgcttcgacag

SEQ ID NO: 415352 - DNA, 24 bp, Artificial Sequence
  Description of Artificial Sequence: Synthetic oligonucleotide
gggggagttcgtgcgcttcgacag

SEQ ID NO: 415353 - DNA, 24 bp, Artificial Sequence
  Description of Artificial Sequence: Synthetic oligonucleotide
ggggagttcgtgcgcttcgacagc

SEQ ID NO: 415354 - DNA, 25 bp, Artificial Sequence
  Description of Artificial Sequence: Synthetic oligonucleotide
gggagttcgtgcgcttcgacagcga

SEQ ID NO: 415355 - DNA, 37 bp, Artificial Sequence; identical to SEQ ID NO: 68582
  Description of Artificial Sequence: Synthetic oligonucleotide

SEQ ID NO: 415356 - DNA, 37 bp, Artificial Sequence; identical to SEQ ID NO: 68583
  Description of Artificial Sequence: Synthetic oligonucleotide

SEQ ID NO: 415357 - DNA, 38 bp, Artificial Sequence; identical to SEQ ID NO: 68584
  Description of Artificial Sequence: Synthetic oligonucleotide

SEQ ID NO: 415358 - DNA, 37 bp, Artificial Sequence; identical to SEQ ID NO: 68585
  Description of Artificial Sequence: Synthetic oligonucleotide

SEQ ID NO: 415359 - DNA, 37 bp, Artificial Sequence; identical to SEQ ID NO: 68586
  Description of Artificial Sequence: Synthetic oligonucleotide

SEQ ID NO: 415360 - DNA, 37 bp, Artificial Sequence; identical to SEQ ID NO: 68587
  Description of Artificial Sequence: Synthetic oligonucleotide

SEQ ID NO: 415361 - DNA, 37 bp, Artificial Sequence; identical to SEQ ID NO: 68588
  Description of Artificial Sequence: Synthetic oligonucleotide

SEQ ID NO: 415362 - DNA, 36 bp, Artificial Sequence; identical to SEQ ID NO: 68589
  Description of Artificial Sequence: Synthetic oligonucleotide

SEQ ID NO: 415363 - DNA, 35 bp, Artificial Sequence; identical to SEQ ID NO: 68590
  Description of Artificial Sequence: Synthetic oligonucleotide

SEQ ID NO: 415364 - DNA, 34 bp, Artificial Sequence; identical to SEQ ID NO: 68591
  Description of Artificial Sequence: Synthetic oligonucleotide

SEQ ID NO: 415365 - DNA, 34 bp, Artificial Sequence; identical to SEQ ID NO: 68592
  Description of Artificial Sequence: Synthetic oligonucleotide

SEQ ID NO: 415366 - DNA, 33 bp, Artificial Sequence; identical to SEQ ID NO: 68593
  Description of Artificial Sequence: Synthetic oligonucleotide

SEQ ID NO: 415367 - DNA, 32 bp, Artificial Sequence; identical to SEQ ID NO: 68594
  Description of Artificial Sequence: Synthetic oligonucleotide

SEQ ID NO: 415368 - DNA, 31 bp, Artificial Sequence; identical to SEQ ID NO: 68595
  Description of Artificial Sequence: Synthetic oligonucleotide

SEQ ID NO: 415369 - DNA, 30 bp, Artificial Sequence; identical to SEQ ID NO: 68596
  Description of Artificial Sequence: Synthetic oligonucleotide

SEQ ID NO: 415370 - DNA, 29 bp, Artificial Sequence
  Description of Artificial Sequence: Synthetic oligonucleotide
gtgtcatttcttcaacgggaaggagcggg

SEQ ID NO: 415371 - DNA, 30 bp, Artificial Sequence; identical to SEQ ID NO: 68598
  Description of Artificial Sequence: Synthetic oligonucleotide

SEQ ID NO: 415372 - DNA, 29 bp, Artificial Sequence
  Description of Artificial Sequence: Synthetic oligonucleotide
gtcatttcttcaacgggaaggagcgggtg

SEQ ID NO: 415373 - DNA, 29 bp, Artificial Sequence
  Description of Artificial Sequence: Synthetic oligonucleotide
tcatttcttcaacgggaaggagcgggtgc

SEQ ID NO: 415374 - DNA, 28 bp, Artificial Sequence
  Description of Artificial Sequence: Synthetic oligonucleotide
catttcttcaacgggaaggagcgggtgc

SEQ ID NO: 415375 - DNA, 29 bp, Artificial Sequence
  Description of Artificial Sequence: Synthetic oligonucleotide
atttcttcaacgggaaggagcgggtgcag

SEQ ID NO: 415376 - DNA, 28 bp, Artificial Sequence
  Description of Artificial Sequence: Synthetic oligonucleotide
tttcttcaacgggaaggagcgggtgcag

SEQ ID NO: 415377 - DNA, 27 bp, Artificial Sequence
  Description of Artificial Sequence: Synthetic oligonucleotide
ttcttcaacgggaaggagcgggtgcag

SEQ ID NO: 415378 - DNA, 27 bp, Artificial Sequence
  Description of Artificial Sequence: Synthetic oligonucleotide
tcttcaacgggaaggagcgggtgcagt

SEQ ID NO: 415379 - DNA, 27 bp, Artificial Sequence
  Description of Artificial Sequence: Synthetic oligonucleotide
cttcaacgggaaggagcgggtgcagtt

SEQ ID NO: 415380 - DNA, 27 bp, Artificial Sequence
  Description of Artificial Sequence: Synthetic oligonucleotide
ttcaacgggaaggagcgggtgcagttc

SEQ ID NO: 415381 - DNA, 26 bp, Artificial Sequence
  Description of Artificial Sequence: Synthetic oligonucleotide
tcaacgggaaggagcgggtgcagttc

SEQ ID NO: 415382 - DNA, 25 bp, Artificial Sequence
  Description of Artificial Sequence: Synthetic oligonucleotide
caacgggaaggagcgggtgcagttc

SEQ ID NO: 415383 - DNA, 26 bp, Artificial Sequence
  Description of Artificial Sequence: Synthetic oligonucleotide
aacgggaaggagcgggtgcagttcct

SEQ ID NO: 415384 - DNA, 25 bp, Artificial Sequence
  Description of Artificial Sequence: Synthetic oligonucleotide
acgggaaggagcgggtgcagttcct

SEQ ID NO: 415385 - DNA, 24 bp, Artificial Sequence
  Description of Artificial Sequence: Synthetic oligonucleotide
cgggaaggagcgggtgcagttcct

SEQ ID NO: 415386 - DNA, 24 bp, Artificial Sequence
  Description of Artificial Sequence: Synthetic oligonucleotide
gggaaggagcgggtgcagttcctg

SEQ ID NO: 415387 - DNA, 27 bp, Artificial Sequence
  Description of Artificial Sequence: Synthetic oligonucleotide
ggaaggagcgggtgcagttcctggaaa

SEQ ID NO: 415388 - DNA, 27 bp, Artificial Sequence
  Description of Artificial Sequence: Synthetic oligonucleotide
gaaggagcgggtgcagttcctggaaag

SEQ ID NO: 415389 - DNA, 28 bp, Artificial Sequence
  Description of Artificial Sequence: Synthetic oligonucleotide
aaggagcgggtgcagttcctggaaagac

SEQ ID NO: 415390 - DNA, 27 bp, Artificial Sequence
  Description of Artificial Sequence: Synthetic oligonucleotide
aggagcgggtgcagttcctggaaagac

SEQ ID NO: 415391 - DNA, 36 bp, Artificial Sequence; identical to SEQ ID NO: 68618
  Description of Artificial Sequence: Synthetic oligonucleotide

SEQ ID NO: 415392 - DNA, 36 bp, Artificial Sequence; identical to SEQ ID NO: 68619
  Description of Artificial Sequence: Synthetic oligonucleotide

SEQ ID NO: 415393 - DNA, 35 bp, Artificial Sequence; identical to SEQ ID NO: 68620
  Description of Artificial Sequence: Synthetic oligonucleotide

SEQ ID NO: 415394 - DNA, 34 bp, Artificial Sequence; identical to SEQ ID NO: 68621
  Description of Artificial Sequence: Synthetic oligonucleotide

SEQ ID NO: 415395 - DNA, 33 bp, Artificial Sequence; identical to SEQ ID NO: 68622
  Description of Artificial Sequence: Synthetic oligonucleotide

SEQ ID NO: 415396 - DNA, 33 bp, Artificial Sequence; identical to SEQ ID NO: 68623
  Description of Artificial Sequence: Synthetic oligonucleotide

SEQ ID NO: 415397 - DNA, 32 bp, Artificial Sequence; identical to SEQ ID NO: 68624
  Description of Artificial Sequence: Synthetic oligonucleotide

SEQ ID NO: 415398 - DNA, 31 bp, Artificial Sequence; identical to SEQ ID NO: 68625
  Description of Artificial Sequence: Synthetic oligonucleotide

SEQ ID NO: 415399 - DNA, 30 bp, Artificial Sequence; identical to SEQ ID NO: 68626
  Description of Artificial Sequence: Synthetic oligonucleotide

SEQ ID NO: 415400 - DNA, 29 bp, Artificial Sequence
  Description of Artificial Sequence: Synthetic oligonucleotide
agtgtcatttcttcaacgggacggagggg

SEQ ID NO: 415401 - DNA, 28 bp, Artificial Sequence
  Description of Artificial Sequence: Synthetic oligonucleotide
gtgtcatttcttcaacgggacggagggg

SEQ ID NO: 415402 - DNA, 28 bp, Artificial Sequence
  Description of Artificial Sequence: Synthetic oligonucleotide
tgtcatttcttcaacgggacggaggggg

SEQ ID NO: 415403 - DNA, 27 bp, Artificial Sequence
  Description of Artificial Sequence: Synthetic oligonucleotide
gtcatttcttcaacgggacggaggggg

SEQ ID NO: 415404 - DNA, 28 bp, Artificial Sequence
  Description of Artificial Sequence: Synthetic oligonucleotide
tcatttcttcaacgggacggagggggtg

SEQ ID NO: 415405 - DNA, 27 bp, Artificial Sequence
  Description of Artificial Sequence: Synthetic oligonucleotide
catttcttcaacgggacggagggggtg

SEQ ID NO: 415406 - DNA, 27 bp, Artificial Sequence
  Description of Artificial Sequence: Synthetic oligonucleotide
atttcttcaacgggacggagggggtgc

SEQ ID NO: 415407 - DNA, 27 bp, Artificial Sequence
  Description of Artificial Sequence: Synthetic oligonucleotide
tttcttcaacgggacggagggggtgca

SEQ ID NO: 415408 - DNA, 26 bp, Artificial Sequence
  Description of Artificial Sequence: Synthetic oligonucleotide
ttcttcaacgggacggagggggtgca

SEQ ID NO: 415409 - DNA, 25 bp, Artificial Sequence
  Description of Artificial Sequence: Synthetic oligonucleotide
tcttcaacgggacggagggggtgca

SEQ ID NO: 415410 - DNA, 24 bp, Artificial Sequence
  Description of Artificial Sequence: Synthetic oligonucleotide
cttcaacgggacggagggggtgca

SEQ ID NO: 415411 - DNA, 26 bp, Artificial Sequence
  Description of Artificial Sequence: Synthetic oligonucleotide
ttcaacgggacggagggggtgcagtt

SEQ ID NO: 415412 - DNA, 25 bp, Artificial Sequence
  Description of Artificial Sequence: Synthetic oligonucleotide
tcaacgggacggagggggtgcagtt

SEQ ID NO: 415413 - DNA, 24 bp, Artificial Sequence
  Description of Artificial Sequence: Synthetic oligonucleotide
caacgggacggagggggtgcagtt

SEQ ID NO: 415414 - DNA, 24 bp, Artificial Sequence
  Description of Artificial Sequence: Synthetic oligonucleotide
aacgggacggagggggtgcagttc

SEQ ID NO: 415415 - DNA, 23 bp, Artificial Sequence
  Description of Artificial Sequence: Synthetic oligonucleotide
acgggacggagggggtgcagttc

SEQ ID NO: 415416 - DNA, 22 bp, Artificial Sequence
  Description of Artificial Sequence: Synthetic oligonucleotide
cgggacggagggggtgcagttc

SEQ ID NO: 415417 - DNA, 23 bp, Artificial Sequence
  Description of Artificial Sequence: Synthetic oligonucleotide
gggacggagggggtgcagttcct

SEQ ID NO: 415418 - DNA, 23 bp, Artificial Sequence
  Description of Artificial Sequence: Synthetic oligonucleotide
ggacggagggggtgcagttcctg

SEQ ID NO: 415419 - DNA, 26 bp, Artificial Sequence
  Description of Artificial Sequence: Synthetic oligonucleotide
gacggagggggtgcagttcctggaaa

SEQ ID NO: 415420 - DNA, 27 bp, Artificial Sequence
  Description of Artificial Sequence: Synthetic oligonucleotide
acggagggggtgcagttcctggaaaga

SEQ ID NO: 415421 - DNA, 26 bp, Artificial Sequence
  Description of Artificial Sequence: Synthetic oligonucleotide
cggagggggtgcagttcctggaaaga

SEQ ID NO: 415422 - DNA, 27 bp, Artificial Sequence
  Description of Artificial Sequence: Synthetic oligonucleotide
ggagggggtgcagttcctggaaagact

SEQ ID NO: 415423 - DNA, 27 bp, Artificial Sequence
  Description of Artificial Sequence: Synthetic oligonucleotide
gagggggtgcagttcctggaaagactc

SEQ ID NO: 415424 - DNA, 29 bp, Artificial Sequence
  Description of Artificial Sequence: Synthetic oligonucleotide
agggggtgcagttcctggaaagactcttc

SEQ ID NO: 415425 - DNA, 28 bp, Artificial Sequence
  Description of Artificial Sequence: Synthetic oligonucleotide
gggggtgcagttcctggaaagactcttc

SEQ ID NO: 415426 - DNA, 33 bp, Artificial Sequence; identical to SEQ ID NO: 68653
  Description of Artificial Sequence: Synthetic oligonucleotide

SEQ ID NO: 415427 - DNA, 27 bp, Artificial Sequence
  Description of Artificial Sequence: Synthetic oligonucleotide
gccagaaggacatcctggaggacaggt

SEQ ID NO: 415428 - DNA, 27 bp, Artificial Sequence
  Description of Artificial Sequence: Synthetic oligonucleotide
ccagaaggacatcctggaggacaggtg

SEQ ID NO: 415429 - DNA, 27 bp, Artificial Sequence
  Description of Artificial Sequence: Synthetic oligonucleotide
cagaaggacatcctggaggacaggtgg

SEQ ID NO: 415430 - DNA, 27 bp, Artificial Sequence
  Description of Artificial Sequence: Synthetic oligonucleotide
agaaggacatcctggaggacaggtggg

SEQ ID NO: 415431 - DNA, 26 bp, Artificial Sequence
  Description of Artificial Sequence: Synthetic oligonucleotide
gaaggacatcctggaggacaggtggg

SEQ ID NO: 415432 - DNA, 26 bp, Artificial Sequence
  Description of Artificial Sequence: Synthetic oligonucleotide
aaggacatcctggaggacaggtgggg

SEQ ID NO: 415433 - DNA, 25 bp, Artificial Sequence
  Description of Artificial Sequence: Synthetic oligonucleotide
aggacatcctggaggacaggtgggg

SEQ ID NO: 415434 - DNA, 24 bp, Artificial Sequence
  Description of Artificial Sequence: Synthetic oligonucleotide
ggacatcctggaggacaggtgggg

SEQ ID NO: 415435 - DNA, 24 bp, Artificial Sequence
  Description of Artificial Sequence: Synthetic oligonucleotide
gacatcctggaggacaggtggggc

SEQ ID NO: 415436 - DNA, 25 bp, Artificial Sequence
  Description of Artificial Sequence: Synthetic oligonucleotide
acatcctggaggacaggtggggcca

SEQ ID NO: 415437 - DNA, 24 bp, Artificial Sequence
  Description of Artificial Sequence: Synthetic oligonucleotide
catcctggaggacaggtggggcca

SEQ ID NO: 415438 - DNA, 24 bp, Artificial Sequence
  Description of Artificial Sequence: Synthetic oligonucleotide
atcctggaggacaggtggggccag

SEQ ID NO: 415439 - DNA, 23 bp, Artificial Sequence
  Description of Artificial Sequence: Synthetic oligonucleotide
tcctggaggacaggtggggccag

SEQ ID NO: 415440 - DNA, 22 bp, Artificial Sequence
  Description of Artificial Sequence: Synthetic oligonucleotide
cctggaggacaggtggggccag

SEQ ID NO: 415441 - DNA, 23 bp, Artificial Sequence
  Description of Artificial Sequence: Synthetic oligonucleotide
ctggaggacaggtggggccaggt

SEQ ID NO: 415442 - DNA, 23 bp, Artificial Sequence
  Description of Artificial Sequence: Synthetic oligonucleotide
tggaggacaggtggggccaggtg

SEQ ID NO: 415443 - DNA, 22 bp, Artificial Sequence
  Description of Artificial Sequence: Synthetic oligonucleotide
ggaggacaggtggggccaggtg

SEQ ID NO: 415444 - DNA, 23 bp, Artificial Sequence
  Description of Artificial Sequence: Synthetic oligonucleotide
gaggacaggtggggccaggtgga

SEQ ID NO: 415445 - DNA, 24 bp, Artificial Sequence
  Description of Artificial Sequence: Synthetic oligonucleotide
aggacaggtggggccaggtggaca

SEQ ID NO: 415446 - DNA, 23 bp, Artificial Sequence
  Description of Artificial Sequence: Synthetic oligonucleotide
ggacaggtggggccaggtggaca

SEQ ID NO: 415447 - DNA, 23 bp, Artificial Sequence
  Description of Artificial Sequence: Synthetic oligonucleotide
gacaggtggggccaggtggacac

SEQ ID NO: 415448 - DNA, 23 bp, Artificial Sequence
  Description of Artificial Sequence: Synthetic oligonucleotide
acaggtggggccaggtggacacc

SEQ ID NO: 415449 - DNA, 22 bp, Artificial Sequence
  Description of Artificial Sequence: Synthetic oligonucleotide
caggtggggccaggtggacacc

SEQ ID NO: 415450 - DNA, 23 bp, Artificial Sequence
  Description of Artificial Sequence: Synthetic oligonucleotide
aggtggggccaggtggacaccgt

SEQ ID NO: 415451 - DNA, 22 bp, Artificial Sequence
  Description of Artificial Sequence: Synthetic oligonucleotide
ggtggggccaggtggacaccgt

SEQ ID NO: 415452 - DNA, 23 bp, Artificial Sequence
  Description of Artificial Sequence: Synthetic oligonucleotide
gtggggccaggtggacaccgtgt

SEQ ID NO: 415453 - DNA, 23 bp, Artificial Sequence
  Description of Artificial Sequence: Synthetic oligonucleotide
tggggccaggtggacaccgtgtg

SEQ ID NO: 415454 - DNA, 27 bp, Artificial Sequence
  Description of Artificial Sequence: Synthetic oligonucleotide
agaaggacatcctggaggacaggcgga

SEQ ID NO: 415455 - DNA, 26 bp, Artificial Sequence
  Description of Artificial Sequence: Synthetic oligonucleotide
gaaggacatcctggaggacaggcgga

SEQ ID NO: 415456 - DNA, 26 bp, Artificial Sequence
  Description of Artificial Sequence: Synthetic oligonucleotide
aaggacatcctggaggacaggcggag

SEQ ID NO: 415457 - DNA, 25 bp, Artificial Sequence
  Description of Artificial Sequence: Synthetic oligonucleotide
aggacatcctggaggacaggcggag

SEQ ID NO: 415458 - DNA, 24 bp, Artificial Sequence
  Description of Artificial Sequence: Synthetic oligonucleotide
ggacatcctggaggacaggcggag

SEQ ID NO: 415459 - DNA, 24 bp, Artificial Sequence
  Description of Artificial Sequence: Synthetic oligonucleotide
gacatcctggaggacaggcggagc

SEQ ID NO: 415460 - DNA, 25 bp, Artificial Sequence
  Description of Artificial Sequence: Synthetic oligonucleotide
acatcctggaggacaggcggagcca

SEQ ID NO: 415461 - DNA, 24 bp, Artificial Sequence
  Description of Artificial Sequence: Synthetic oligonucleotide
catcctggaggacaggcggagcca

SEQ ID NO: 415462 - DNA, 24 bp, Artificial Sequence
  Description of Artificial Sequence: Synthetic oligonucleotide
atcctggaggacaggcggagccag

SEQ ID NO: 415463 - DNA, 23 bp, Artificial Sequence
  Description of Artificial Sequence: Synthetic oligonucleotide
tcctggaggacaggcggagccag

SEQ ID NO: 415464 - DNA, 22 bp, Artificial Sequence
  Description of Artificial Sequence: Synthetic oligonucleotide
cctggaggacaggcggagccag

SEQ ID NO: 415465 - DNA, 23 bp, Artificial Sequence
  Description of Artificial Sequence: Synthetic oligonucleotide
ctggaggacaggcggagccaggt

SEQ ID NO: 415466 - DNA, 23 bp, Artificial Sequence
  Description of Artificial Sequence: Synthetic oligonucleotide
tggaggacaggcggagccaggtg

SEQ ID NO: 415467 - DNA, 22 bp, Artificial Sequence
  Description of Artificial Sequence: Synthetic oligonucleotide
ggaggacaggcggagccaggtg

SEQ ID NO: 415468 - DNA, 23 bp, Artificial Sequence
  Description of Artificial Sequence: Synthetic oligonucleotide
gaggacaggcggagccaggtgga

SEQ ID NO: 415469 - DNA, 24 bp, Artificial Sequence
  Description of Artificial Sequence: Synthetic oligonucleotide
aggacaggcggagccaggtggaca

SEQ ID NO: 415470 - DNA, 23 bp, Artificial Sequence
  Description of Artificial Sequence: Synthetic oligonucleotide
ggacaggcggagccaggtggaca

SEQ ID NO: 415471 - DNA, 23 bp, Artificial Sequence
  Description of Artificial Sequence: Synthetic oligonucleotide
gacaggcggagccaggtggacac

SEQ ID NO: 415472 - DNA, 23 bp, Artificial Sequence
  Description of Artificial Sequence: Synthetic oligonucleotide
acaggcggagccaggtggacacc

SEQ ID NO: 415473 - DNA, 22 bp, Artificial Sequence
  Description of Artificial Sequence: Synthetic oligonucleotide
caggcggagccaggtggacacc

SEQ ID NO: 415474 - DNA, 23 bp, Artificial Sequence
  Description of Artificial Sequence: Synthetic oligonucleotide
aggcggagccaggtggacaccgt

SEQ ID NO: 415475 - DNA, 22 bp, Artificial Sequence
  Description of Artificial Sequence: Synthetic oligonucleotide
ggcggagccaggtggacaccgt

SEQ ID NO: 415476 - DNA, 23 bp, Artificial Sequence
  Description of Artificial Sequence: Synthetic oligonucleotide
gcggagccaggtggacaccgtgt

SEQ ID NO: 415477 - DNA, 23 bp, Artificial Sequence
  Description of Artificial Sequence: Synthetic oligonucleotide
cggagccaggtggacaccgtgtg

SEQ ID NO: 415478 - DNA, 24 bp, Artificial Sequence
  Description of Artificial Sequence: Synthetic oligonucleotide
ggagccaggtggacaccgtgtgca

SEQ ID NO: 415479 - DNA, 25 bp, Artificial Sequence
  Description of Artificial Sequence: Synthetic oligonucleotide
gagccaggtggacaccgtgtgcaga

SEQ ID NO: 415480 - DNA, 26 bp, Artificial Sequence
  Description of Artificial Sequence: Synthetic oligonucleotide
agccaggtggacaccgtgtgcagaca

SEQ ID NO: 415481 - DNA, 23 bp, Artificial Sequence
  Description of Artificial Sequence: Synthetic oligonucleotide
gacgtgggggagtaccgggcgtt

SEQ ID NO: 415482 - DNA, 24 bp, Artificial Sequence
  Description of Artificial Sequence: Synthetic oligonucleotide
acgtgggggagtaccgggcgttga

SEQ ID NO: 415483 - DNA, 23 bp, Artificial Sequence
  Description of Artificial Sequence: Synthetic oligonucleotide
cgtgggggagtaccgggcgttga

SEQ ID NO: 415484 - DNA, 23 bp, Artificial Sequence
  Description of Artificial Sequence: Synthetic oligonucleotide
gtgggggagtaccgggcgttgac

SEQ ID NO: 415485 - DNA, 23 bp, Artificial Sequence
  Description of Artificial Sequence: Synthetic oligonucleotide
tgggggagtaccgggcgttgacg

SEQ ID NO: 415486 - DNA, 22 bp, Artificial Sequence
  Description of Artificial Sequence: Synthetic oligonucleotide
gggggagtaccgggcgttgacg

SEQ ID NO: 415487 - DNA, 23 bp, Artificial Sequence
  Description of Artificial Sequence: Synthetic oligonucleotide
ggggagtaccgggcgttgacgga

SEQ ID NO: 415488 - DNA, 23 bp, Artificial Sequence
  Description of Artificial Sequence: Synthetic oligonucleotide
gggagtaccgggcgttgacggag

SEQ ID NO: 415489 - DNA, 25 bp, Artificial Sequence
  Description of Artificial Sequence: Synthetic oligonucleotide
ggagtaccgggcgttgacggagcta

SEQ ID NO: 415490 - DNA, 25 bp, Artificial Sequence
  Description of Artificial Sequence: Synthetic oligonucleotide
gagtaccgggcgttgacggagctag

SEQ ID NO: 415491 - DNA, 25 bp, Artificial Sequence
  Description of Artificial Sequence: Synthetic oligonucleotide
agtaccgggcgttgacggagctagg

SEQ ID NO: 415492 - DNA, 24 bp, Artificial Sequence
  Description of Artificial Sequence: Synthetic oligonucleotide
gtaccgggcgttgacggagctagg

SEQ ID NO: 415493 - DNA, 24 bp, Artificial Sequence
  Description of Artificial Sequence: Synthetic oligonucleotide
taccgggcgttgacggagctaggg

SEQ ID NO: 415494 - DNA, 23 bp, Artificial Sequence
  Description of Artificial Sequence: Synthetic oligonucleotide
accgggcgttgacggagctaggg

SEQ ID NO: 415495 - DNA, 22 bp, Artificial Sequence
  Description of Artificial Sequence: Synthetic oligonucleotide
ccgggcgttgacggagctaggg

SEQ ID NO: 415496 - DNA, 22 bp, Artificial Sequence
  Description of Artificial Sequence: Synthetic oligonucleotide
cgggcgttgacggagctagggc

SEQ ID NO: 415497 - DNA, 22 bp, Artificial Sequence
  Description of Artificial Sequence: Synthetic oligonucleotide
gggcgttgacggagctagggcg

SEQ ID NO: 415498 - DNA, 22 bp, Artificial Sequence
  Description of Artificial Sequence: Synthetic oligonucleotide
ggcgttgacggagctagggcgg

SEQ ID NO: 415499 - DNA, 22 bp, Artificial Sequence
  Description of Artificial Sequence: Synthetic oligonucleotide
gcgttgacggagctagggcggc

SEQ ID NO: 415500 - DNA, 23 bp, Artificial Sequence
  Description of Artificial Sequence: Synthetic oligonucleotide
cgttgacggagctagggcggcct

SEQ ID NO: 415501 - DNA, 24 bp, Artificial Sequence
  Description of Artificial Sequence: Synthetic oligonucleotide
gttgacggagctagggcggcctgt

SEQ ID NO: 415502 - DNA, 24 bp, Artificial Sequence
  Description of Artificial Sequence: Synthetic oligonucleotide
ttgacggagctagggcggcctgtc

SEQ ID NO: 415503 - DNA, 29 bp, Artificial Sequence
  Description of Artificial Sequence: Synthetic oligonucleotide
cgtgtgcagacacaactacggggttgatg

SEQ ID NO: 415504 - DNA, 30 bp, Artificial Sequence
  Description of Artificial Sequence: Synthetic oligonucleotide
gtgtgcagacacaactacggggttgatgag

SEQ ID NO: 415505 - DNA, 31 bp, Artificial Sequence
  Description of Artificial Sequence: Synthetic oligonucleotide
tgtgcagacacaactacggggttgatgagag

SEQ ID NO: 415506 - DNA, 30 bp, Artificial Sequence
  Description of Artificial Sequence: Synthetic oligonucleotide
gtgcagacacaactacggggttgatgagag

SEQ ID NO: 415507 - DNA, 30 bp, Artificial Sequence; identical to SEQ ID NO: 70852
  Description of Artificial Sequence: Synthetic oligonucleotide

SEQ ID NO: 415508 - DNA, 29 bp, Artificial Sequence
  Description of Artificial Sequence: Synthetic oligonucleotide
gcagacacaactacggggttgatgagagc

SEQ ID NO: 415509 - DNA, 31 bp, Artificial Sequence; identical to SEQ ID NO: 70854
  Description of Artificial Sequence: Synthetic oligonucleotide

SEQ ID NO: 415510 - DNA, 32 bp, Artificial Sequence; identical to SEQ ID NO: 70855
  Description of Artificial Sequence: Synthetic oligonucleotide

SEQ ID NO: 415511 - DNA, 31 bp, Artificial Sequence; identical to SEQ ID NO: 70856
  Description of Artificial Sequence: Synthetic oligonucleotide

SEQ ID NO: 415512 - DNA, 32 bp, Artificial Sequence; identical to SEQ ID NO: 70857
  Description of Artificial Sequence: Synthetic oligonucleotide

SEQ ID NO: 415513 - DNA, 31 bp, Artificial Sequence; identical to SEQ ID NO: 70858
  Description of Artificial Sequence: Synthetic oligonucleotide

SEQ ID NO: 415514 - DNA, 32 bp, Artificial Sequence; identical to SEQ ID NO: 70859
  Description of Artificial Sequence: Synthetic oligonucleotide

SEQ ID NO: 415515 - DNA, 31 bp, Artificial Sequence; identical to SEQ ID NO: 70860
  Description of Artificial Sequence: Synthetic oligonucleotide

SEQ ID NO: 415516 - DNA, 31 bp, Artificial Sequence; identical to SEQ ID NO: 70861
  Description of Artificial Sequence: Synthetic oligonucleotide

SEQ ID NO: 415517 - DNA, 30 bp, Artificial Sequence; identical to SEQ ID NO: 70862
  Description of Artificial Sequence: Synthetic oligonucleotide

SEQ ID NO: 415518 - DNA, 29 bp, Artificial Sequence
  Description of Artificial Sequence: Synthetic oligonucleotide
ctacggggttgatgagagcttcacagtgc

SEQ ID NO: 415519 - DNA, 30 bp, Artificial Sequence; identical to SEQ ID NO: 70864
  Description of Artificial Sequence: Synthetic oligonucleotide

SEQ ID NO: 415520 - DNA, 29 bp, Artificial Sequence
  Description of Artificial Sequence: Synthetic oligonucleotide
acggggttgatgagagcttcacagtgcag

SEQ ID NO: 415521 - DNA, 28 bp, Artificial Sequence
  Description of Artificial Sequence: Synthetic oligonucleotide
cggggttgatgagagcttcacagtgcag

SEQ ID NO: 415522 - DNA, 28 bp, Artificial Sequence
  Description of Artificial Sequence: Synthetic oligonucleotide
ggggttgatgagagcttcacagtgcagc

SEQ ID NO: 415523 - DNA, 28 bp, Artificial Sequence
  Description of Artificial Sequence: Synthetic oligonucleotide
gggttgatgagagcttcacagtgcagcg

SEQ ID NO: 415524 - DNA, 28 bp, Artificial Sequence
  Description of Artificial Sequence: Synthetic oligonucleotide
ggttgatgagagcttcacagtgcagcgg

SEQ ID NO: 415525 - DNA, 28 bp, Artificial Sequence
  Description of Artificial Sequence: Synthetic oligonucleotide
gttgatgagagcttcacagtgcagcggc

SEQ ID NO: 415526 - DNA, 28 bp, Artificial Sequence
  Description of Artificial Sequence: Synthetic oligonucleotide
ttgatgagagcttcacagtgcagcggcg

SEQ ID NO: 415527 - DNA, 27 bp, Artificial Sequence
  Description of Artificial Sequence: Synthetic oligonucleotide
tgatgagagcttcacagtgcagcggcg

SEQ ID NO: 415528 - DNA, 27 bp, Artificial Sequence
  Description of Artificial Sequence: Synthetic oligonucleotide
gatgagagcttcacagtgcagcggcga

SEQ ID NO: 415529 - DNA, 27 bp, Artificial Sequence
  Description of Artificial Sequence: Synthetic oligonucleotide
atgagagcttcacagtgcagcggcgag

SEQ ID NO: 415530 - DNA, 37 bp, Artificial Sequence
  Description of Artificial Sequence: Synthetic oligonucleotide
ctgtggcagggtaagtataagtgtcatttcttcaacc

SEQ ID NO: 415531 - DNA, 37 bp, Artificial Sequence
  Description of Artificial Sequence: Synthetic oligonucleotide
tgtggcagggtaagtataagtgtcatttcttcaaccg

SEQ ID NO: 415532 - DNA, 36 bp, Artificial Sequence
  Description of Artificial Sequence: Synthetic oligonucleotide
gtggcagggtaagtataagtgtcatttcttcaaccg

SEQ ID NO: 415533 - DNA, 36 bp, Artificial Sequence
  Description of Artificial Sequence: Synthetic oligonucleotide
tggcagggtaagtataagtgtcatttcttcaaccgg

SEQ ID NO: 415534 - DNA, 35 bp, Artificial Sequence
  Description of Artificial Sequence: Synthetic oligonucleotide
ggcagggtaagtataagtgtcatttcttcaaccgg

SEQ ID NO: 415535 - DNA, 36 bp, Artificial Sequence
  Description of Artificial Sequence: Synthetic oligonucleotide
gcagggtaagtataagtgtcatttcttcaaccggac

SEQ ID NO: 415536 - DNA, 36 bp, Artificial Sequence
  Description of Artificial Sequence: Synthetic oligonucleotide
cagggtaagtataagtgtcatttcttcaaccggacg

SEQ ID NO: 415537 - DNA, 36 bp, Artificial Sequence
  Description of Artificial Sequence: Synthetic oligonucleotide
agggtaagtataagtgtcatttcttcaaccggacgg

SEQ ID NO: 415538 - DNA, 35 bp, Artificial Sequence
  Description of Artificial Sequence: Synthetic oligonucleotide
gggtaagtataagtgtcatttcttcaaccggacgg

SEQ ID NO: 415539 - DNA, 36 bp, Artificial Sequence
  Description of Artificial Sequence: Synthetic oligonucleotide
ggtaagtataagtgtcatttcttcaaccggacggag

SEQ ID NO: 415540 - DNA, 36 bp, Artificial Sequence
  Description of Artificial Sequence: Synthetic oligonucleotide
gtaagtataagtgtcatttcttcaaccggacggagc

SEQ ID NO: 415541 - DNA, 36 bp, Artificial Sequence
  Description of Artificial Sequence: Synthetic oligonucleotide
taagtataagtgtcatttcttcaaccggacggagcg

SEQ ID NO: 415542 - DNA, 35 bp, Artificial Sequence
  Description of Artificial Sequence: Synthetic oligonucleotide
aagtataagtgtcatttcttcaaccggacggagcg

SEQ ID NO: 415543 - DNA, 34 bp, Artificial Sequence
  Description of Artificial Sequence: Synthetic oligonucleotide
agtataagtgtcatttcttcaaccggacggagcg

SEQ ID NO: 415544 - DNA, 33 bp, Artificial Sequence
  Description of Artificial Sequence: Synthetic oligonucleotide
gtataagtgtcatttcttcaaccggacggagcg

SEQ ID NO: 415545 - DNA, 33 bp, Artificial Sequence
  Description of Artificial Sequence: Synthetic oligonucleotide
tataagtgtcatttcttcaaccggacggagcgg

SEQ ID NO: 415546 - DNA, 32 bp, Artificial Sequence
  Description of Artificial Sequence: Synthetic oligonucleotide
ataagtgtcatttcttcaaccggacggagcgg

SEQ ID NO: 415547 - DNA, 31 bp, Artificial Sequence
  Description of Artificial Sequence: Synthetic oligonucleotide
taagtgtcatttcttcaaccggacggagcgg

SEQ ID NO: 415548 - DNA, 30 bp, Artificial Sequence
  Description of Artificial Sequence: Synthetic oligonucleotide
aagtgtcatttcttcaaccggacggagcgg

SEQ ID NO: 415549 - DNA, 27 bp, Artificial Sequence
  Description of Artificial Sequence: Synthetic oligonucleotide
tttcttcaaccggacggagcgggtgca

SEQ ID NO: 415550 - DNA, 26 bp, Artificial Sequence
  Description of Artificial Sequence: Synthetic oligonucleotide
ttcttcaaccggacggagcgggtgca

SEQ ID NO: 415551 - DNA, 25 bp, Artificial Sequence
  Description of Artificial Sequence: Synthetic oligonucleotide
tcttcaaccggacggagcgggtgca

SEQ ID NO: 415552 - DNA, 24 bp, Artificial Sequence
  Description of Artificial Sequence: Synthetic oligonucleotide
cttcaaccggacggagcgggtgca

SEQ ID NO: 415553 - DNA, 26 bp, Artificial Sequence
  Description of Artificial Sequence: Synthetic oligonucleotide
ttcaaccggacggagcgggtgcagtt

SEQ ID NO: 415554 - DNA, 25 bp, Artificial Sequence
  Description of Artificial Sequence: Synthetic oligonucleotide
tcaaccggacggagcgggtgcagtt

SEQ ID NO: 415555 - DNA, 24 bp, Artificial Sequence
  Description of Artificial Sequence: Synthetic oligonucleotide
caaccggacggagcgggtgcagtt

SEQ ID NO: 415556 - DNA, 24 bp, Artificial Sequence
  Description of Artificial Sequence: Synthetic oligonucleotide
aaccggacggagcgggtgcagttc

SEQ ID NO: 415557 - DNA, 23 bp, Artificial Sequence
  Description of Artificial Sequence: Synthetic oligonucleotide
accggacggagcgggtgcagttc

SEQ ID NO: 415558 - DNA, 22 bp, Artificial Sequence
  Description of Artificial Sequence: Synthetic oligonucleotide
ccggacggagcgggtgcagttc

SEQ ID NO: 415559 - DNA, 23 bp, Artificial Sequence
  Description of Artificial Sequence: Synthetic oligonucleotide
cggacggagcgggtgcagttcct

SEQ ID NO: 415560 - DNA, 27 bp, Artificial Sequence
  Description of Artificial Sequence: Synthetic oligonucleotide
gggacacccgaccacgtttcttggagt

SEQ ID NO: 415561 - DNA, 28 bp, Artificial Sequence
  Description of Artificial Sequence: Synthetic oligonucleotide
ggacacccgaccacgtttcttggagtac

SEQ ID NO: 415562 - DNA, 29 bp, Artificial Sequence
  Description of Artificial Sequence: Synthetic oligonucleotide
gacacccgaccacgtttcttggagtactc

SEQ ID NO: 415563 - DNA, 31 bp, Artificial Sequence; identical to SEQ ID NO: 68706
  Description of Artificial Sequence: Synthetic oligonucleotide

SEQ ID NO: 415564 - DNA, 30 bp, Artificial Sequence; identical to SEQ ID NO: 68707
  Description of Artificial Sequence: Synthetic oligonucleotide

SEQ ID NO: 415565 - DNA, 30 bp, Artificial Sequence; identical to SEQ ID NO: 68708
  Description of Artificial Sequence: Synthetic oligonucleotide

SEQ ID NO: 415566 - DNA, 29 bp, Artificial Sequence
  Description of Artificial Sequence: Synthetic oligonucleotide
cccgaccacgtttcttggagtactctacg

SEQ ID NO: 415567 - DNA, 29 bp, Artificial Sequence
  Description of Artificial Sequence: Synthetic oligonucleotide
ccgaccacgtttcttggagtactctacgg

SEQ ID NO: 415568 - DNA, 29 bp, Artificial Sequence
  Description of Artificial Sequence: Synthetic oligonucleotide
cgaccacgtttcttggagtactctacggg

SEQ ID NO: 415569 - DNA, 30 bp, Artificial Sequence; identical to SEQ ID NO: 68712
  Description of Artificial Sequence: Synthetic oligonucleotide

SEQ ID NO: 415570 - DNA, 31 bp, Artificial Sequence; identical to SEQ ID NO: 68713
  Description of Artificial Sequence: Synthetic oligonucleotide

SEQ ID NO: 415571 - DNA, 30 bp, Artificial Sequence; identical to SEQ ID NO: 68714
  Description of Artificial Sequence: Synthetic oligonucleotide

SEQ ID NO: 415572 - DNA, 31 bp, Artificial Sequence; identical to SEQ ID NO: 68715
  Description of Artificial Sequence: Synthetic oligonucleotide

SEQ ID NO: 415573 - DNA, 37 bp, Artificial Sequence; identical to SEQ ID NO: 68716
  Description of Artificial Sequence: Synthetic oligonucleotide

SEQ ID NO: 415574 - DNA, 36 bp, Artificial Sequence; identical to SEQ ID NO: 68717
  Description of Artificial Sequence: Synthetic oligonucleotide

SEQ ID NO: 415575 - DNA, 38 bp, Artificial Sequence; identical to SEQ ID NO: 68718
  Description of Artificial Sequence: Synthetic oligonucleotide

SEQ ID NO: 415576 - DNA, 41 bp, Artificial Sequence; identical to SEQ ID NO: 68719
  Description of Artificial Sequence: Synthetic oligonucleotide

SEQ ID NO: 415577 - DNA, 40 bp, Artificial Sequence; identical to SEQ ID NO: 68720
  Description of Artificial Sequence: Synthetic oligonucleotide

SEQ ID NO: 415578 - DNA, 39 bp, Artificial Sequence; identical to SEQ ID NO: 68721
  Description of Artificial Sequence: Synthetic oligonucleotide

SEQ ID NO: 415579 - DNA, 38 bp, Artificial Sequence; identical to SEQ ID NO: 68722
  Description of Artificial Sequence: Synthetic oligonucleotide

SEQ ID NO: 415580 - DNA, 38 bp, Artificial Sequence; identical to SEQ ID NO: 68723
  Description of Artificial Sequence: Synthetic oligonucleotide

SEQ ID NO: 415581 - DNA, 37 bp, Artificial Sequence; identical to SEQ ID NO: 68724
  Description of Artificial Sequence: Synthetic oligonucleotide

SEQ ID NO: 415582 - DNA, 36 bp, Artificial Sequence; identical to SEQ ID NO: 68725
  Description of Artificial Sequence: Synthetic oligonucleotide

SEQ ID NO: 415583 - DNA, 36 bp, Artificial Sequence; identical to SEQ ID NO: 68726
  Description of Artificial Sequence: Synthetic oligonucleotide

SEQ ID NO: 415584 - DNA, 37 bp, Artificial Sequence; identical to SEQ ID NO: 68727
  Description of Artificial Sequence: Synthetic oligonucleotide

SEQ ID NO: 415585 - DNA, 36 bp, Artificial Sequence; identical to SEQ ID NO: 68728
  Description of Artificial Sequence: Synthetic oligonucleotide

SEQ ID NO: 415586 - DNA, 36 bp, Artificial Sequence; identical to SEQ ID NO: 68729
  Description of Artificial Sequence: Synthetic oligonucleotide

SEQ ID NO: 415587 - DNA, 35 bp, Artificial Sequence; identical to SEQ ID NO: 68730
  Description of Artificial Sequence: Synthetic oligonucleotide

SEQ ID NO: 415588 - DNA, 34 bp, Artificial Sequence; identical to SEQ ID NO: 68731
  Description of Artificial Sequence: Synthetic oligonucleotide

SEQ ID NO: 415589 - DNA, 34 bp, Artificial Sequence; identical to SEQ ID NO: 68732
  Description of Artificial Sequence: Synthetic oligonucleotide

SEQ ID NO: 415590 - DNA, 33 bp, Artificial Sequence; identical to SEQ ID NO: 68733
  Description of Artificial Sequence: Synthetic oligonucleotide

SEQ ID NO: 415591 - DNA, 34 bp, Artificial Sequence; identical to SEQ ID NO: 68734
  Description of Artificial Sequence: Synthetic oligonucleotide

SEQ ID NO: 415592 - DNA, 33 bp, Artificial Sequence; identical to SEQ ID NO: 68735
  Description of Artificial Sequence: Synthetic oligonucleotide

SEQ ID NO: 415593 - DNA, 32 bp, Artificial Sequence; identical to SEQ ID NO: 68736
  Description of Artificial Sequence: Synthetic oligonucleotide

SEQ ID NO: 415594 - DNA, 32 bp, Artificial Sequence; identical to SEQ ID NO: 68737
  Description of Artificial Sequence: Synthetic oligonucleotide

SEQ ID NO: 415595 - DNA, 32 bp, Artificial Sequence; identical to SEQ ID NO: 68738
  Description of Artificial Sequence: Synthetic oligonucleotide

SEQ ID NO: 415596 - DNA, 32 bp, Artificial Sequence; identical to SEQ ID NO: 68739
  Description of Artificial Sequence: Synthetic oligonucleotide

SEQ ID NO: 415597 - DNA, 32 bp, Artificial Sequence; identical to SEQ ID NO: 68740
  Description of Artificial Sequence: Synthetic oligonucleotide

SEQ ID NO: 415598 - DNA, 31 bp, Artificial Sequence; identical to SEQ ID NO: 68741
  Description of Artificial Sequence: Synthetic oligonucleotide

SEQ ID NO: 415599 - DNA, 32 bp, Artificial Sequence; identical to SEQ ID NO: 68742
  Description of Artificial Sequence: Synthetic oligonucleotide

SEQ ID NO: 415600 - DNA, 31 bp, Artificial Sequence; identical to SEQ ID NO: 68743
  Description of Artificial Sequence: Synthetic oligonucleotide

SEQ ID NO: 415601 - DNA, 31 bp, Artificial Sequence; identical to SEQ ID NO: 68744
  Description of Artificial Sequence: Synthetic oligonucleotide

SEQ ID NO: 415602 - DNA, 30 bp, Artificial Sequence; identical to SEQ ID NO: 68745
  Description of Artificial Sequence: Synthetic oligonucleotide

SEQ ID NO: 415603 - DNA, 30 bp, Artificial Sequence; identical to SEQ ID NO: 68746
  Description of Artificial Sequence: Synthetic oligonucleotide

SEQ ID NO: 415604 - DNA, 29 bp, Artificial Sequence
  Description of Artificial Sequence: Synthetic oligonucleotide
tatttcttcaatgggacggagcgggtgcg

SEQ ID NO: 415605 - DNA, 25 bp, Artificial Sequence
  Description of Artificial Sequence: Synthetic oligonucleotide
agagcttcacggtgcagcggcgagt

SEQ ID NO: 415606 - DNA, 24 bp, Artificial Sequence
  Description of Artificial Sequence: Synthetic oligonucleotide
gagcttcacggtgcagcggcgagt

SEQ ID NO: 415607 - DNA, 24 bp, Artificial Sequence
  Description of Artificial Sequence: Synthetic oligonucleotide
agcttcacggtgcagcggcgagtc

SEQ ID NO: 415608 - DNA, 23 bp, Artificial Sequence
  Description of Artificial Sequence: Synthetic oligonucleotide
gcttcacggtgcagcggcgagtc

SEQ ID NO: 415609 - DNA, 25 bp, Artificial Sequence
  Description of Artificial Sequence: Synthetic oligonucleotide
cttcacggtgcagcggcgagtccat

SEQ ID NO: 415610 - DNA, 25 bp, Artificial Sequence
  Description of Artificial Sequence: Synthetic oligonucleotide
ttcacggtgcagcggcgagtccatc

SEQ ID NO: 415611 - DNA, 24 bp, Artificial Sequence
  Description of Artificial Sequence: Synthetic oligonucleotide
tcacggtgcagcggcgagtccatc

SEQ ID NO: 415612 - DNA, 23 bp, Artificial Sequence
  Description of Artificial Sequence: Synthetic oligonucleotide
cacggtgcagcggcgagtccatc

SEQ ID NO: 415613 - DNA, 26 bp, Artificial Sequence
  Description of Artificial Sequence: Synthetic oligonucleotide
acggtgcagcggcgagtccatcctaa

SEQ ID NO: 415614 - DNA, 25 bp, Artificial Sequence
  Description of Artificial Sequence: Synthetic oligonucleotide
cggtgcagcggcgagtccatcctaa

SEQ ID NO: 415615 - DNA, 25 bp, Artificial Sequence
  Description of Artificial Sequence: Synthetic oligonucleotide
ggtgcagcggcgagtccatcctaag

SEQ ID NO: 415616 - DNA, 25 bp, Artificial Sequence
  Description of Artificial Sequence: Synthetic oligonucleotide
acctgccaagtggagcacccaagcg

SEQ ID NO: 415617 - DNA, 27 bp, Artificial Sequence
  Description of Artificial Sequence: Synthetic oligonucleotide
gagcgggtgcggttcctggacagatat

SEQ ID NO: 415618 - DNA, 29 bp, Artificial Sequence
  Description of Artificial Sequence: Synthetic oligonucleotide
agcgggtgcggttcctggacagatatttc

SEQ ID NO: 415619 - DNA, 28 bp, Artificial Sequence
  Description of Artificial Sequence: Synthetic oligonucleotide
gcgggtgcggttcctggacagatatttc

SEQ ID NO: 415620 - DNA, 33 bp, Artificial Sequence; identical to SEQ ID NO: 68763
  Description of Artificial Sequence: Synthetic oligonucleotide

SEQ ID NO: 415621 - DNA, 33 bp, Artificial Sequence; identical to SEQ ID NO: 68764
  Description of Artificial Sequence: Synthetic oligonucleotide

SEQ ID NO: 415622 - DNA, 35 bp, Artificial Sequence; identical to SEQ ID NO: 68765
  Description of Artificial Sequence: Synthetic oligonucleotide

SEQ ID NO: 415623 - DNA, 36 bp, Artificial Sequence; identical to SEQ ID NO: 68766
  Description of Artificial Sequence: Synthetic oligonucleotide

SEQ ID NO: 415624 - DNA, 36 bp, Artificial Sequence; identical to SEQ ID NO: 68767
  Description of Artificial Sequence: Synthetic oligonucleotide

SEQ ID NO: 415625 - DNA, 35 bp, Artificial Sequence; identical to SEQ ID NO: 68768
  Description of Artificial Sequence: Synthetic oligonucleotide

SEQ ID NO: 415626 - DNA, 36 bp, Artificial Sequence; identical to SEQ ID NO: 68769
  Description of Artificial Sequence: Synthetic oligonucleotide

SEQ ID NO: 415627 - DNA, 38 bp, Artificial Sequence; identical to SEQ ID NO: 68770
  Description of Artificial Sequence: Synthetic oligonucleotide

SEQ ID NO: 415628 - DNA, 38 bp, Artificial Sequence; identical to SEQ ID NO: 68771
  Description of Artificial Sequence: Synthetic oligonucleotide

SEQ ID NO: 415629 - DNA, 39 bp, Artificial Sequence; identical to SEQ ID NO: 68772
  Description of Artificial Sequence: Synthetic oligonucleotide

SEQ ID NO: 415630 - DNA, 38 bp, Artificial Sequence; identical to SEQ ID NO: 68773
  Description of Artificial Sequence: Synthetic oligonucleotide

SEQ ID NO: 415631 - DNA, 37 bp, Artificial Sequence; identical to SEQ ID NO: 68774
  Description of Artificial Sequence: Synthetic oligonucleotide

SEQ ID NO: 415632 - DNA, 37 bp, Artificial Sequence; identical to SEQ ID NO: 68775
  Description of Artificial Sequence: Synthetic oligonucleotide

SEQ ID NO: 415633 - DNA, 37 bp, Artificial Sequence; identical to SEQ ID NO: 68776
  Description of Artificial Sequence: Synthetic oligonucleotide

SEQ ID NO: 415634 - DNA, 36 bp, Artificial Sequence; identical to SEQ ID NO: 68777
  Description of Artificial Sequence: Synthetic oligonucleotide

SEQ ID NO: 415635 - DNA, 36 bp, Artificial Sequence; identical to SEQ ID NO: 68778
  Description of Artificial Sequence: Synthetic oligonucleotide

SEQ ID NO: 415636 - DNA, 38 bp, Artificial Sequence; identical to SEQ ID NO: 68779
  Description of Artificial Sequence: Synthetic oligonucleotide

SEQ ID NO: 415637 - DNA, 37 bp, Artificial Sequence; identical to SEQ ID NO: 68780
  Description of Artificial Sequence: Synthetic oligonucleotide

SEQ ID NO: 415638 - DNA, 37 bp, Artificial Sequence; identical to SEQ ID NO: 68781
  Description of Artificial Sequence: Synthetic oligonucleotide

SEQ ID NO: 415639 - DNA, 36 bp, Artificial Sequence; identical to SEQ ID NO: 68782
  Description of Artificial Sequence: Synthetic oligonucleotide

SEQ ID NO: 415640 - DNA, 37 bp, Artificial Sequence; identical to SEQ ID NO: 68783
  Description of Artificial Sequence: Synthetic oligonucleotide

SEQ ID NO: 415641 - DNA, 36 bp, Artificial Sequence; identical to SEQ ID NO: 68784
  Description of Artificial Sequence: Synthetic oligonucleotide

SEQ ID NO: 415642 - DNA, 35 bp, Artificial Sequence; identical to SEQ ID NO: 68785
  Description of Artificial Sequence: Synthetic oligonucleotide

SEQ ID NO: 415643 - DNA, 34 bp, Artificial Sequence; identical to SEQ ID NO: 68786
  Description of Artificial Sequence: Synthetic oligonucleotide

SEQ ID NO: 415644 - DNA, 31 bp, Artificial Sequence; identical to SEQ ID NO: 68787
  Description of Artificial Sequence: Synthetic oligonucleotide

SEQ ID NO: 415645 - DNA, 30 bp, Artificial Sequence; identical to SEQ ID NO: 68788
  Description of Artificial Sequence: Synthetic oligonucleotide

SEQ ID NO: 415646 - DNA, 30 bp, Artificial Sequence; identical to SEQ ID NO: 68789
  Description of Artificial Sequence: Synthetic oligonucleotide

SEQ ID NO: 415647 - DNA, 31 bp, Artificial Sequence; identical to SEQ ID NO: 68790
  Description of Artificial Sequence: Synthetic oligonucleotide

SEQ ID NO: 415648 - DNA, 30 bp, Artificial Sequence; identical to SEQ ID NO: 68791
  Description of Artificial Sequence: Synthetic oligonucleotide

SEQ ID NO: 415649 - DNA, 29 bp, Artificial Sequence
  Description of Artificial Sequence: Synthetic oligonucleotide
gacaagccctctcacagtggaatggagtg

SEQ ID NO: 415650 - DNA, 29 bp, Artificial Sequence
  Description of Artificial Sequence: Synthetic oligonucleotide
acaagccctctcacagtggaatggagtgc

SEQ ID NO: 415651 - DNA, 28 bp, Artificial Sequence
  Description of Artificial Sequence: Synthetic oligonucleotide
caagccctctcacagtggaatggagtgc

SEQ ID NO: 415652 - DNA, 29 bp, Artificial Sequence
  Description of Artificial Sequence: Synthetic oligonucleotide
aagccctctcacagtggaatggagtgcac

SEQ ID NO: 415653 - DNA, 28 bp, Artificial Sequence
  Description of Artificial Sequence: Synthetic oligonucleotide
agccctctcacagtggaatggagtgcac

SEQ ID NO: 415654 - DNA, 27 bp, Artificial Sequence
  Description of Artificial Sequence: Synthetic oligonucleotide
gccctctcacagtggaatggagtgcac

SEQ ID NO: 415655 - DNA, 27 bp, Artificial Sequence
  Description of Artificial Sequence: Synthetic oligonucleotide
ccctctcacagtggaatggagtgcacg

SEQ ID NO: 415656 - DNA, 27 bp, Artificial Sequence
  Description of Artificial Sequence: Synthetic oligonucleotide
cctctcacagtggaatggagtgcacgg

SEQ ID NO: 415657 - DNA, 28 bp, Artificial Sequence
  Description of Artificial Sequence: Synthetic oligonucleotide
ctctcacagtggaatggagtgcacggtc

SEQ ID NO: 415658 - DNA, 29 bp, Artificial Sequence
  Description of Artificial Sequence: Synthetic oligonucleotide
tctcacagtggaatggagtgcacggtctg

SEQ ID NO: 415659 - DNA, 28 bp, Artificial Sequence
  Description of Artificial Sequence: Synthetic oligonucleotide
ctcacagtggaatggagtgcacggtctg

SEQ ID NO: 415660 - DNA, 31 bp, Artificial Sequence; identical to SEQ ID NO: 68803
  Description of Artificial Sequence: Synthetic oligonucleotide

SEQ ID NO: 415661 - DNA, 30 bp, Artificial Sequence; identical to SEQ ID NO: 68804
  Description of Artificial Sequence: Synthetic oligonucleotide

SEQ ID NO: 415662 - DNA, 31 bp, Artificial Sequence; identical to SEQ ID NO: 68805
  Description of Artificial Sequence: Synthetic oligonucleotide

SEQ ID NO: 415663 - DNA, 30 bp, Artificial Sequence; identical to SEQ ID NO: 68806
  Description of Artificial Sequence: Synthetic oligonucleotide

SEQ ID NO: 415664 - DNA, 30 bp, Artificial Sequence; identical to SEQ ID NO: 68807
  Description of Artificial Sequence: Synthetic oligonucleotide

SEQ ID NO: 415665 - DNA, 29 bp, Artificial Sequence
  Description of Artificial Sequence: Synthetic oligonucleotide
gtggaatggagtgcacggtctgaatctgc

SEQ ID NO: 415666 - DNA, 30 bp, Artificial Sequence; identical to SEQ ID NO: 68809
  Description of Artificial Sequence: Synthetic oligonucleotide

SEQ ID NO: 415667 - DNA, 29 bp, Artificial Sequence
  Description of Artificial Sequence: Synthetic oligonucleotide
ggaatggagtgcacggtctgaatctgcac

SEQ ID NO: 415668 - DNA, 30 bp, Artificial Sequence; identical to SEQ ID NO: 68811
  Description of Artificial Sequence: Synthetic oligonucleotide

SEQ ID NO: 415669 - DNA, 31 bp, Artificial Sequence; identical to SEQ ID NO: 68812
  Description of Artificial Sequence: Synthetic oligonucleotide

SEQ ID NO: 415670 - DNA, 30 bp, Artificial Sequence; identical to SEQ ID NO: 68813
  Description of Artificial Sequence: Synthetic oligonucleotide

SEQ ID NO: 415671 - DNA, 29 bp, Artificial Sequence
  Description of Artificial Sequence: Synthetic oligonucleotide
tggagtgcacggtctgaatctgcacagag

SEQ ID NO: 415672 - DNA, 28 bp, Artificial Sequence
  Description of Artificial Sequence: Synthetic oligonucleotide
ggagtgcacggtctgaatctgcacagag

SEQ ID NO: 415673 - DNA, 28 bp, Artificial Sequence
  Description of Artificial Sequence: Synthetic oligonucleotide
gagtgcacggtctgaatctgcacagagc

SEQ ID NO: 415674 - DNA, 30 bp, Artificial Sequence; identical to SEQ ID NO: 68817
  Description of Artificial Sequence: Synthetic oligonucleotide

SEQ ID NO: 415675 - DNA, 29 bp, Artificial Sequence
  Description of Artificial Sequence: Synthetic oligonucleotide
gtgcacggtctgaatctgcacagagcaag

SEQ ID NO: 415676 - DNA, 31 bp, Artificial Sequence; identical to SEQ ID NO: 68819
  Description of Artificial Sequence: Synthetic oligonucleotide

SEQ ID NO: 415677 - DNA, 40 bp, Artificial Sequence; identical to SEQ ID NO: 68820
  Description of Artificial Sequence: Synthetic oligonucleotide

SEQ ID NO: 415678 - DNA, 39 bp, Artificial Sequence; identical to SEQ ID NO: 68821
  Description of Artificial Sequence: Synthetic oligonucleotide

SEQ ID NO: 415679 - DNA, 38 bp, Artificial Sequence; identical to SEQ ID NO: 68822
  Description of Artificial Sequence: Synthetic oligonucleotide

SEQ ID NO: 415680 - DNA, 37 bp, Artificial Sequence; identical to SEQ ID NO: 68823
  Description of Artificial Sequence: Synthetic oligonucleotide

SEQ ID NO: 415681 - DNA, 37 bp, Artificial Sequence; identical to SEQ ID NO: 68824
  Description of Artificial Sequence: Synthetic oligonucleotide

SEQ ID NO: 415682 - DNA, 36 bp, Artificial Sequence; identical to SEQ ID NO: 68825
  Description of Artificial Sequence: Synthetic oligonucleotide

SEQ ID NO: 415683 - DNA, 35 bp, Artificial Sequence; identical to SEQ ID NO: 68826
  Description of Artificial Sequence: Synthetic oligonucleotide

SEQ ID NO: 415684 - DNA, 35 bp, Artificial Sequence; identical to SEQ ID NO: 68827
  Description of Artificial Sequence: Synthetic oligonucleotide

SEQ ID NO: 415685 - DNA, 35 bp, Artificial Sequence; identical to SEQ ID NO: 68828
  Description of Artificial Sequence: Synthetic oligonucleotide

SEQ ID NO: 415686 - DNA, 34 bp, Artificial Sequence; identical to SEQ ID NO: 68829
  Description of Artificial Sequence: Synthetic oligonucleotide

SEQ ID NO: 415687 - DNA, 35 bp, Artificial Sequence; identical to SEQ ID NO: 68830
  Description of Artificial Sequence: Synthetic oligonucleotide

SEQ ID NO: 415688 - DNA, 34 bp, Artificial Sequence; identical to SEQ ID NO: 68831
  Description of Artificial Sequence: Synthetic oligonucleotide

SEQ ID NO: 415689 - DNA, 33 bp, Artificial Sequence; identical to SEQ ID NO: 68832
  Description of Artificial Sequence: Synthetic oligonucleotide

SEQ ID NO: 415690 - DNA, 33 bp, Artificial Sequence; identical to SEQ ID NO: 68833
  Description of Artificial Sequence: Synthetic oligonucleotide

SEQ ID NO: 415691 - DNA, 32 bp, Artificial Sequence; identical to SEQ ID NO: 68834
  Description of Artificial Sequence: Synthetic oligonucleotide

SEQ ID NO: 415692 - DNA, 32 bp, Artificial Sequence; identical to SEQ ID NO: 68835
  Description of Artificial Sequence: Synthetic oligonucleotide

SEQ ID NO: 415693 - DNA, 31 bp, Artificial Sequence; identical to SEQ ID NO: 68836
  Description of Artificial Sequence: Synthetic oligonucleotide

SEQ ID NO: 415694 - DNA, 30 bp, Artificial Sequence; identical to SEQ ID NO: 68837
  Description of Artificial Sequence: Synthetic oligonucleotide

SEQ ID NO: 415695 - DNA, 31 bp, Artificial Sequence; identical to SEQ ID NO: 68838
  Description of Artificial Sequence: Synthetic oligonucleotide

SEQ ID NO: 415696 - DNA, 31 bp, Artificial Sequence; identical to SEQ ID NO: 68839
  Description of Artificial Sequence: Synthetic oligonucleotide

SEQ ID NO: 415697 - DNA, 31 bp, Artificial Sequence; identical to SEQ ID NO: 68840
  Description of Artificial Sequence: Synthetic oligonucleotide

SEQ ID NO: 415698 - DNA, 31 bp, Artificial Sequence; identical to SEQ ID NO: 68841
  Description of Artificial Sequence: Synthetic oligonucleotide

SEQ ID NO: 415699 - DNA, 30 bp, Artificial Sequence; identical to SEQ ID NO: 68842
  Description of Artificial Sequence: Synthetic oligonucleotide

SEQ ID NO: 415700 - DNA, 30 bp, Artificial Sequence; identical to SEQ ID NO: 68843
  Description of Artificial Sequence: Synthetic oligonucleotide

SEQ ID NO: 415701 - DNA, 29 bp, Artificial Sequence
  Description of Artificial Sequence: Synthetic oligonucleotide
gtgttatttcttcaacgggacggagcggg

SEQ ID NO: 415702 - DNA, 30 bp, Artificial Sequence; identical to SEQ ID NO: 68845
  Description of Artificial Sequence: Synthetic oligonucleotide

SEQ ID NO: 415703 - DNA, 29 bp, Artificial Sequence
  Description of Artificial Sequence: Synthetic oligonucleotide
gttatttcttcaacgggacggagcgggtg

SEQ ID NO: 415704 - DNA, 29 bp, Artificial Sequence
  Description of Artificial Sequence: Synthetic oligonucleotide
ttatttcttcaacgggacggagcgggtgc

SEQ ID NO: 415705 - DNA, 28 bp, Artificial Sequence
  Description of Artificial Sequence: Synthetic oligonucleotide
tatttcttcaacgggacggagcgggtgc

SEQ ID NO: 415706 - DNA, 23 bp, Artificial Sequence
  Description of Artificial Sequence: Synthetic oligonucleotide
tgggggagtaccgggcggtgaca

SEQ ID NO: 415707 - DNA, 22 bp, Artificial Sequence
  Description of Artificial Sequence: Synthetic oligonucleotide
gggggagtaccgggcggtgaca

SEQ ID NO: 415708 - DNA, 23 bp, Artificial Sequence
  Description of Artificial Sequence: Synthetic oligonucleotide
ggggagtaccgggcggtgacaga

SEQ ID NO: 415709 - DNA, 23 bp, Artificial Sequence
  Description of Artificial Sequence: Synthetic oligonucleotide
gggagtaccgggcggtgacagag

SEQ ID NO: 415710 - DNA, 24 bp, Artificial Sequence
  Description of Artificial Sequence: Synthetic oligonucleotide
ggagtaccgggcggtgacagagct

SEQ ID NO: 415711 - DNA, 24 bp, Artificial Sequence
  Description of Artificial Sequence: Synthetic oligonucleotide
gagtaccgggcggtgacagagctg

SEQ ID NO: 415712 - DNA, 24 bp, Artificial Sequence
  Description of Artificial Sequence: Synthetic oligonucleotide
agtaccgggcggtgacagagctgg

SEQ ID NO: 415713 - DNA, 23 bp, Artificial Sequence
  Description of Artificial Sequence: Synthetic oligonucleotide
gtaccgggcggtgacagagctgg

SEQ ID NO: 415714 - DNA, 23 bp, Artificial Sequence
  Description of Artificial Sequence: Synthetic oligonucleotide
taccgggcggtgacagagctggg

SEQ ID NO: 415715 - DNA, 22 bp, Artificial Sequence
  Description of Artificial Sequence: Synthetic oligonucleotide
accgggcggtgacagagctggg

SEQ ID NO: 415716 - DNA, 25 bp, Artificial Sequence
  Description of Artificial Sequence: Synthetic oligonucleotide
aggcgggccctggtggacacctatt

SEQ ID NO: 415717 - DNA, 24 bp, Artificial Sequence
  Description of Artificial Sequence: Synthetic oligonucleotide
ggcgggccctggtggacacctatt

SEQ ID NO: 415718 - DNA, 24 bp, Artificial Sequence
  Description of Artificial Sequence: Synthetic oligonucleotide
gcgggccctggtggacacctattg

SEQ ID NO: 415719 - DNA, 25 bp, Artificial Sequence
  Description of Artificial Sequence: Synthetic oligonucleotide
cgggccctggtggacacctattgca

SEQ ID NO: 415720 - DNA, 26 bp, Artificial Sequence
  Description of Artificial Sequence: Synthetic oligonucleotide
gggccctggtggacacctattgcaga

SEQ ID NO: 415721 - DNA, 27 bp, Artificial Sequence
  Description of Artificial Sequence: Synthetic oligonucleotide
ggccctggtggacacctattgcagaca

SEQ ID NO: 415722 - DNA, 27 bp, Artificial Sequence
  Description of Artificial Sequence: Synthetic oligonucleotide
gccctggtggacacctattgcagacac

SEQ ID NO: 415723 - DNA, 29 bp, Artificial Sequence
  Description of Artificial Sequence: Synthetic oligonucleotide
ccctggtggacacctattgcagacacaac

SEQ ID NO: 415724 - DNA, 31 bp, Artificial Sequence; identical to SEQ ID NO: 72129
  Description of Artificial Sequence: Synthetic oligonucleotide

SEQ ID NO: 415725 - DNA, 31 bp, Artificial Sequence; identical to SEQ ID NO: 72130
  Description of Artificial Sequence: Synthetic oligonucleotide

SEQ ID NO: 415726 - DNA, 31 bp, Artificial Sequence; identical to SEQ ID NO: 72131
  Description of Artificial Sequence: Synthetic oligonucleotide

SEQ ID NO: 415727 - DNA, 32 bp, Artificial Sequence
  Description of Artificial Sequence: Synthetic oligonucleotide
gttccctccatctcctttactcctgaacacac

SEQ ID NO: 415728 - DNA, 33 bp, Artificial Sequence
  Description of Artificial Sequence: Synthetic oligonucleotide
ttccctccatctcctttactcctgaacacactc

SEQ ID NO: 415729 - DNA, 32 bp, Artificial Sequence
  Description of Artificial Sequence: Synthetic oligonucleotide
tccctccatctcctttactcctgaacacactc

SEQ ID NO: 415730 - DNA, 33 bp, Artificial Sequence
  Description of Artificial Sequence: Synthetic oligonucleotide
ctccatctcctttactcctgaacacactcacac

SEQ ID NO: 415731 - DNA, 34 bp, Artificial Sequence
  Description of Artificial Sequence: Synthetic oligonucleotide
tccatctcctttactcctgaacacactcacacac

SEQ ID NO: 415732 - DNA, 33 bp, Artificial Sequence
  Description of Artificial Sequence: Synthetic oligonucleotide
ccatctcctttactcctgaacacactcacacac

SEQ ID NO: 415733 - DNA, 34 bp, Artificial Sequence
  Description of Artificial Sequence: Synthetic oligonucleotide
catctcctttactcctgaacacactcacacactc

SEQ ID NO: 415734 - DNA, 35 bp, Artificial Sequence
  Description of Artificial Sequence: Synthetic oligonucleotide
atctcctttactcctgaacacactcacacactcac

SEQ ID NO: 415735 - DNA, 34 bp, Artificial Sequence
  Description of Artificial Sequence: Synthetic oligonucleotide
tctcctttactcctgaacacactcacacactcac

SEQ ID NO: 415736 - DNA, 33 bp, Artificial Sequence
  Description of Artificial Sequence: Synthetic oligonucleotide
ctcctttactcctgaacacactcacacactcac

SEQ ID NO: 415737 - DNA, 34 bp, Artificial Sequence
  Description of Artificial Sequence: Synthetic oligonucleotide
tcctttactcctgaacacactcacacactcactc

SEQ ID NO: 415738 - DNA, 33 bp, Artificial Sequence
  Description of Artificial Sequence: Synthetic oligonucleotide
cctttactcctgaacacactcacacactcactc

SEQ ID NO: 415739 - DNA, 33 bp, Artificial Sequence
  Description of Artificial Sequence: Synthetic oligonucleotide
ctttactcctgaacacactcacacactcactcc

SEQ ID NO: 415740 - DNA, 34 bp, Artificial Sequence
  Description of Artificial Sequence: Synthetic oligonucleotide
tttactcctgaacacactcacacactcactcctg

SEQ ID NO: 415741 - DNA, 33 bp, Artificial Sequence
  Description of Artificial Sequence: Synthetic oligonucleotide
ttactcctgaacacactcacacactcactcctg

SEQ ID NO: 415742 - DNA, 32 bp, Artificial Sequence
  Description of Artificial Sequence: Synthetic oligonucleotide
tactcctgaacacactcacacactcactcctg

SEQ ID NO: 415743 - DNA, 31 bp, Artificial Sequence
  Description of Artificial Sequence: Synthetic oligonucleotide
actcctgaacacactcacacactcactcctg

SEQ ID NO: 415744 - DNA, 30 bp, Artificial Sequence
  Description of Artificial Sequence: Synthetic oligonucleotide
ctcctgaacacactcacacactcactcctg

SEQ ID NO: 415745 - DNA, 30 bp, Artificial Sequence
  Description of Artificial Sequence: Synthetic oligonucleotide
tcctgaacacactcacacactcactcctgc

SEQ ID NO: 415746 - DNA, 29 bp, Artificial Sequence
  Description of Artificial Sequence: Synthetic oligonucleotide
cctgaacacactcacacactcactcctgc

SEQ ID NO: 415747 - DNA, 32 bp, Artificial Sequence
  Description of Artificial Sequence: Synthetic oligonucleotide
ctgaacacactcacacactcactcctgcaaac

SEQ ID NO: 415748 - DNA, 33 bp, Artificial Sequence
  Description of Artificial Sequence: Synthetic oligonucleotide
tgaacacactcacacactcactcctgcaaacag

SEQ ID NO: 415749 - DNA, 32 bp, Artificial Sequence
  Description of Artificial Sequence: Synthetic oligonucleotide
gaacacactcacacactcactcctgcaaacag

SEQ ID NO: 415750 - DNA, 34 bp, Artificial Sequence
  Description of Artificial Sequence: Synthetic oligonucleotide
aacacactcacacactcactcctgcaaacagttc

SEQ ID NO: 415751 - DNA, 33 bp, Artificial Sequence
  Description of Artificial Sequence: Synthetic oligonucleotide
acacactcacacactcactcctgcaaacagttc

SEQ ID NO: 415752 - DNA, 32 bp, Artificial Sequence
  Description of Artificial Sequence: Synthetic oligonucleotide
cacactcacacactcactcctgcaaacagttc

SEQ ID NO: 415753 - DNA, 33 bp, Artificial Sequence
  Description of Artificial Sequence: Synthetic oligonucleotide
acactcacacactcactcctgcaaacagttctc

SEQ ID NO: 415754 - DNA, 32 bp, Artificial Sequence
  Description of Artificial Sequence: Synthetic oligonucleotide
cactcacacactcactcctgcaaacagttctc

SEQ ID NO: 415755 - DNA, 34 bp, Artificial Sequence
  Description of Artificial Sequence: Synthetic oligonucleotide
actcacacactcactcctgcaaacagttctcttg

SEQ ID NO: 415756 - DNA, 33 bp, Artificial Sequence
  Description of Artificial Sequence: Synthetic oligonucleotide
ctcacacactcactcctgcaaacagttctcttg

SEQ ID NO: 415757 - DNA, 34 bp, Artificial Sequence
  Description of Artificial Sequence: Synthetic oligonucleotide
tcacacactcactcctgcaaacagttctcttgtc

SEQ ID NO: 415758 - DNA, 33 bp, Artificial Sequence
  Description of Artificial Sequence: Synthetic oligonucleotide
cacacactcactcctgcaaacagttctcttgtc

SEQ ID NO: 415759 - DNA, 36 bp, Artificial Sequence; identical to SEQ ID NO: 68859
  Description of Artificial Sequence: Synthetic oligonucleotide

SEQ ID NO: 415760 - DNA, 35 bp, Artificial Sequence; identical to SEQ ID NO: 68860
  Description of Artificial Sequence: Synthetic oligonucleotide

SEQ ID NO: 415761 - DNA, 34 bp, Artificial Sequence; identical to SEQ ID NO: 68861
  Description of Artificial Sequence: Synthetic oligonucleotide

SEQ ID NO: 415762 - DNA, 34 bp, Artificial Sequence; identical to SEQ ID NO: 68862
  Description of Artificial Sequence: Synthetic oligonucleotide

SEQ ID NO: 415763 - DNA, 33 bp, Artificial Sequence; identical to SEQ ID NO: 68863
  Description of Artificial Sequence: Synthetic oligonucleotide

SEQ ID NO: 415764 - DNA, 32 bp, Artificial Sequence; identical to SEQ ID NO: 68864
  Description of Artificial Sequence: Synthetic oligonucleotide

SEQ ID NO: 415765 - DNA, 33 bp, Artificial Sequence; identical to SEQ ID NO: 68865
  Description of Artificial Sequence: Synthetic oligonucleotide

SEQ ID NO: 415766 - DNA, 32 bp, Artificial Sequence; identical to SEQ ID NO: 68866
  Description of Artificial Sequence: Synthetic oligonucleotide

SEQ ID NO: 415767 - DNA, 31 bp, Artificial Sequence; identical to SEQ ID NO: 68867
  Description of Artificial Sequence: Synthetic oligonucleotide

SEQ ID NO: 415768 - DNA, 31 bp, Artificial Sequence; identical to SEQ ID NO: 68868
  Description of Artificial Sequence: Synthetic oligonucleotide

SEQ ID NO: 415769 - DNA, 30 bp, Artificial Sequence; identical to SEQ ID NO: 68869
  Description of Artificial Sequence: Synthetic oligonucleotide

SEQ ID NO: 415770 - DNA, 30 bp, Artificial Sequence; identical to SEQ ID NO: 68870
  Description of Artificial Sequence: Synthetic oligonucleotide

SEQ ID NO: 415771 - DNA, 32 bp, Artificial Sequence; identical to SEQ ID NO: 68871
  Description of Artificial Sequence: Synthetic oligonucleotide

SEQ ID NO: 415772 - DNA, 31 bp, Artificial Sequence; identical to SEQ ID NO: 68872
  Description of Artificial Sequence: Synthetic oligonucleotide

SEQ ID NO: 415773 - DNA, 30 bp, Artificial Sequence; identical to SEQ ID NO: 68873
  Description of Artificial Sequence: Synthetic oligonucleotide

SEQ ID NO: 415774 - DNA, 29 bp, Artificial Sequence
  Description of Artificial Sequence: Synthetic oligonucleotide
cagaaaggacactctggactccagccaac

SEQ ID NO: 415775 - DNA, 30 bp, Artificial Sequence; identical to SEQ ID NO: 68875
  Description of Artificial Sequence: Synthetic oligonucleotide

SEQ ID NO: 415776 - DNA, 29 bp, Artificial Sequence
  Description of Artificial Sequence: Synthetic oligonucleotide
gaaaggacactctggactccagccaacag

SEQ ID NO: 415777 - DNA, 29 bp, Artificial Sequence
  Description of Artificial Sequence: Synthetic oligonucleotide
aaaggacactctggactccagccaacagg

SEQ ID NO: 415778 - DNA, 28 bp, Artificial Sequence
  Description of Artificial Sequence: Synthetic oligonucleotide
aaggacactctggactccagccaacagg

SEQ ID NO: 415779 - DNA, 27 bp, Artificial Sequence
  Description of Artificial Sequence: Synthetic oligonucleotide
aggacactctggactccagccaacagg

SEQ ID NO: 415780 - DNA, 27 bp, Artificial Sequence
  Description of Artificial Sequence: Synthetic oligonucleotide
ggacactctggactccagccaacagga

SEQ ID NO: 415781 - DNA, 29 bp, Artificial Sequence
  Description of Artificial Sequence: Synthetic oligonucleotide
gacactctggactccagccaacaggattc

SEQ ID NO: 415782 - DNA, 29 bp, Artificial Sequence
  Description of Artificial Sequence: Synthetic oligonucleotide
acactctggactccagccaacaggattcc

SEQ ID NO: 415783 - DNA, 28 bp, Artificial Sequence
  Description of Artificial Sequence: Synthetic oligonucleotide
cactctggactccagccaacaggattcc

SEQ ID NO: 415784 - DNA, 29 bp, Artificial Sequence
  Description of Artificial Sequence: Synthetic oligonucleotide
actctggactccagccaacaggattcctg

SEQ ID NO: 415785 - DNA, 28 bp, Artificial Sequence
  Description of Artificial Sequence: Synthetic oligonucleotide
ctctggactccagccaacaggattcctg

SEQ ID NO: 415786 - DNA, 29 bp, Artificial Sequence
  Description of Artificial Sequence: Synthetic oligonucleotide
tctggactccagccaacaggattcctgag

SEQ ID NO: 415787 - DNA, 28 bp, Artificial Sequence
  Description of Artificial Sequence: Synthetic oligonucleotide
ctggactccagccaacaggattcctgag

SEQ ID NO: 415788 - DNA, 28 bp, Artificial Sequence
  Description of Artificial Sequence: Synthetic oligonucleotide
tggactccagccaacaggattcctgagc

SEQ ID NO: 415789 - DNA, 27 bp, Artificial Sequence
  Description of Artificial Sequence: Synthetic oligonucleotide
ggactccagccaacaggattcctgagc

SEQ ID NO: 415790 - DNA, 28 bp, Artificial Sequence
  Description of Artificial Sequence: Synthetic oligonucleotide
gactccagccaacaggattcctgagctg

SEQ ID NO: 415791 - DNA, 31 bp, Artificial Sequence; identical to SEQ ID NO: 68891
  Description of Artificial Sequence: Synthetic oligonucleotide

SEQ ID NO: 415792 - DNA, 30 bp, Artificial Sequence; identical to SEQ ID NO: 68892
  Description of Artificial Sequence: Synthetic oligonucleotide

SEQ ID NO: 415793 - DNA, 31 bp, Artificial Sequence; identical to SEQ ID NO: 68893
  Description of Artificial Sequence: Synthetic oligonucleotide

SEQ ID NO: 415794 - DNA, 32 bp, Artificial Sequence; identical to SEQ ID NO: 68894
  Description of Artificial Sequence: Synthetic oligonucleotide

SEQ ID NO: 415795 - DNA, 31 bp, Artificial Sequence; identical to SEQ ID NO: 68895
  Description of Artificial Sequence: Synthetic oligonucleotide

SEQ ID NO: 415796 - DNA, 30 bp, Artificial Sequence; identical to SEQ ID NO: 68896
  Description of Artificial Sequence: Synthetic oligonucleotide

SEQ ID NO: 415797 - DNA, 30 bp, Artificial Sequence; identical to SEQ ID NO: 68897
  Description of Artificial Sequence: Synthetic oligonucleotide

SEQ ID NO: 415798 - DNA, 29 bp, Artificial Sequence
  Description of Artificial Sequence: Synthetic oligonucleotide
gcagacacaactacggggttgttgagagc

SEQ ID NO: 415799 - DNA, 31 bp, Artificial Sequence; identical to SEQ ID NO: 68899
  Description of Artificial Sequence: Synthetic oligonucleotide

SEQ ID NO: 415800 - DNA, 32 bp, Artificial Sequence; identical to SEQ ID NO: 68900
  Description of Artificial Sequence: Synthetic oligonucleotide

SEQ ID NO: 415801 - DNA, 31 bp, Artificial Sequence; identical to SEQ ID NO: 68901
  Description of Artificial Sequence: Synthetic oligonucleotide

SEQ ID NO: 415802 - DNA, 32 bp, Artificial Sequence; identical to SEQ ID NO: 68902
  Description of Artificial Sequence: Synthetic oligonucleotide

SEQ ID NO: 415803 - DNA, 31 bp, Artificial Sequence; identical to SEQ ID NO: 68903
  Description of Artificial Sequence: Synthetic oligonucleotide

SEQ ID NO: 415804 - DNA, 32 bp, Artificial Sequence; identical to SEQ ID NO: 68904
  Description of Artificial Sequence: Synthetic oligonucleotide

SEQ ID NO: 415805 - DNA, 31 bp, Artificial Sequence; identical to SEQ ID NO: 68905
  Description of Artificial Sequence: Synthetic oligonucleotide

SEQ ID NO: 415806 - DNA, 31 bp, Artificial Sequence; identical to SEQ ID NO: 68906
  Description of Artificial Sequence: Synthetic oligonucleotide

SEQ ID NO: 415807 - DNA, 30 bp, Artificial Sequence; identical to SEQ ID NO: 68907
  Description of Artificial Sequence: Synthetic oligonucleotide

SEQ ID NO: 415808 - DNA, 29 bp, Artificial Sequence
  Description of Artificial Sequence: Synthetic oligonucleotide
ctacggggttgttgagagcttcacagtgc

SEQ ID NO: 415809 - DNA, 30 bp, Artificial Sequence; identical to SEQ ID NO: 68909
  Description of Artificial Sequence: Synthetic oligonucleotide

SEQ ID NO: 415810 - DNA, 29 bp, Artificial Sequence
  Description of Artificial Sequence: Synthetic oligonucleotide
acggggttgttgagagcttcacagtgcag

SEQ ID NO: 415811 - DNA, 28 bp, Artificial Sequence
  Description of Artificial Sequence: Synthetic oligonucleotide
cggggttgttgagagcttcacagtgcag

SEQ ID NO: 415812 - DNA, 28 bp, Artificial Sequence
  Description of Artificial Sequence: Synthetic oligonucleotide
ggggttgttgagagcttcacagtgcagc

SEQ ID NO: 415813 - DNA, 28 bp, Artificial Sequence
  Description of Artificial Sequence: Synthetic oligonucleotide
gggttgttgagagcttcacagtgcagcg

SEQ ID NO: 415814 - DNA, 28 bp, Artificial Sequence
  Description of Artificial Sequence: Synthetic oligonucleotide
ggttgttgagagcttcacagtgcagcgg

SEQ ID NO: 415815 - DNA, 31 bp, Artificial Sequence; identical to SEQ ID NO: 68915
  Description of Artificial Sequence: Synthetic oligonucleotide

SEQ ID NO: 415816 - DNA, 30 bp, Artificial Sequence; identical to SEQ ID NO: 68916
  Description of Artificial Sequence: Synthetic oligonucleotide

SEQ ID NO: 415817 - DNA, 30 bp, Artificial Sequence; identical to SEQ ID NO: 68917
  Description of Artificial Sequence: Synthetic oligonucleotide

SEQ ID NO: 415818 - DNA, 29 bp, Artificial Sequence
  Description of Artificial Sequence: Synthetic oligonucleotide
caactacggggttgttgagagcttcacgg

SEQ ID NO: 415819 - DNA, 30 bp, Artificial Sequence; identical to SEQ ID NO: 68919
  Description of Artificial Sequence: Synthetic oligonucleotide

SEQ ID NO: 415820 - DNA, 29 bp, Artificial Sequence
  Description of Artificial Sequence: Synthetic oligonucleotide
actacggggttgttgagagcttcacggtg

SEQ ID NO: 415821 - DNA, 28 bp, Artificial Sequence
  Description of Artificial Sequence: Synthetic oligonucleotide
ctacggggttgttgagagcttcacggtg

SEQ ID NO: 415822 - DNA, 28 bp, Artificial Sequence
  Description of Artificial Sequence: Synthetic oligonucleotide
tacggggttgttgagagcttcacggtgc

SEQ ID NO: 415823 - DNA, 27 bp, Artificial Sequence
  Description of Artificial Sequence: Synthetic oligonucleotide
acggggttgttgagagcttcacggtgc

SEQ ID NO: 415824 - DNA, 27 bp, Artificial Sequence
  Description of Artificial Sequence: Synthetic oligonucleotide
cggggttgttgagagcttcacggtgca

SEQ ID NO: 415825 - DNA, 27 bp, Artificial Sequence
  Description of Artificial Sequence: Synthetic oligonucleotide
ggggttgttgagagcttcacggtgcag

SEQ ID NO: 415826 - DNA, 27 bp, Artificial Sequence
  Description of Artificial Sequence: Synthetic oligonucleotide
gggttgttgagagcttcacggtgcagc

SEQ ID NO: 415827 - DNA, 27 bp, Artificial Sequence
  Description of Artificial Sequence: Synthetic oligonucleotide
ggttgttgagagcttcacggtgcagcg

SEQ ID NO: 415828 - DNA, 27 bp, Artificial Sequence
  Description of Artificial Sequence: Synthetic oligonucleotide
gttgttgagagcttcacggtgcagcgg

SEQ ID NO: 415829 - DNA, 27 bp, Artificial Sequence
  Description of Artificial Sequence: Synthetic oligonucleotide
ttgttgagagcttcacggtgcagcggc

SEQ ID NO: 415830 - DNA, 26 bp, Artificial Sequence
  Description of Artificial Sequence: Synthetic oligonucleotide
tgttgagagcttcacggtgcagcggc

SEQ ID NO: 415831 - DNA, 25 bp, Artificial Sequence
  Description of Artificial Sequence: Synthetic oligonucleotide
gttgagagcttcacggtgcagcggc

SEQ ID NO: 415832 - DNA, 26 bp, Artificial Sequence
  Description of Artificial Sequence: Synthetic oligonucleotide
ttgagagcttcacggtgcagcggcga

SEQ ID NO: 415833 - DNA, 36 bp, Artificial Sequence; identical to SEQ ID NO: 68950
  Description of Artificial Sequence: Synthetic oligonucleotide

SEQ ID NO: 415834 - DNA, 36 bp, Artificial Sequence; identical to SEQ ID NO: 68951
  Description of Artificial Sequence: Synthetic oligonucleotide

SEQ ID NO: 415835 - DNA, 35 bp, Artificial Sequence; identical to SEQ ID NO: 68952
  Description of Artificial Sequence: Synthetic oligonucleotide

SEQ ID NO: 415836 - DNA, 35 bp, Artificial Sequence; identical to SEQ ID NO: 68953
  Description of Artificial Sequence: Synthetic oligonucleotide

SEQ ID NO: 415837 - DNA, 35 bp, Artificial Sequence; identical to SEQ ID NO: 68954
  Description of Artificial Sequence: Synthetic oligonucleotide

SEQ ID NO: 415838 - DNA, 34 bp, Artificial Sequence; identical to SEQ ID NO: 68955
  Description of Artificial Sequence: Synthetic oligonucleotide

SEQ ID NO: 415839 - DNA, 36 bp, Artificial Sequence; identical to SEQ ID NO: 68956
  Description of Artificial Sequence: Synthetic oligonucleotide

SEQ ID NO: 415840 - DNA, 35 bp, Artificial Sequence; identical to SEQ ID NO: 68957
  Description of Artificial Sequence: Synthetic oligonucleotide

SEQ ID NO: 415841 - DNA, 35 bp, Artificial Sequence; identical to SEQ ID NO: 68958
  Description of Artificial Sequence: Synthetic oligonucleotide

SEQ ID NO: 415842 - DNA, 34 bp, Artificial Sequence; identical to SEQ ID NO: 68959
  Description of Artificial Sequence: Synthetic oligonucleotide

SEQ ID NO: 415843 - DNA, 33 bp, Artificial Sequence; identical to SEQ ID NO: 68960
  Description of Artificial Sequence: Synthetic oligonucleotide

SEQ ID NO: 415844 - DNA, 32 bp, Artificial Sequence; identical to SEQ ID NO: 68961
  Description of Artificial Sequence: Synthetic oligonucleotide

SEQ ID NO: 415845 - DNA, 33 bp, Artificial Sequence; identical to SEQ ID NO: 68962
  Description of Artificial Sequence: Synthetic oligonucleotide

SEQ ID NO: 415846 - DNA, 32 bp, Artificial Sequence; identical to SEQ ID NO: 68963
  Description of Artificial Sequence: Synthetic oligonucleotide

SEQ ID NO: 415847 - DNA, 31 bp, Artificial Sequence; identical to SEQ ID NO: 68964
  Description of Artificial Sequence: Synthetic oligonucleotide

SEQ ID NO: 415848 - DNA, 32 bp, Artificial Sequence; identical to SEQ ID NO: 68965
  Description of Artificial Sequence: Synthetic oligonucleotide

SEQ ID NO: 415849 - DNA, 31 bp, Artificial Sequence; identical to SEQ ID NO: 68966
  Description of Artificial Sequence: Synthetic oligonucleotide

SEQ ID NO: 415850 - DNA, 30 bp, Artificial Sequence; identical to SEQ ID NO: 68967
  Description of Artificial Sequence: Synthetic oligonucleotide

SEQ ID NO: 415851 - DNA, 29 bp, Artificial Sequence
  Description of Artificial Sequence: Synthetic oligonucleotide
aaccaagaggagtacgtccgcttcgacag

SEQ ID NO: 415852 - DNA, 28 bp, Artificial Sequence
  Description of Artificial Sequence: Synthetic oligonucleotide
accaagaggagtacgtccgcttcgacag

SEQ ID NO: 415853 - DNA, 27 bp, Artificial Sequence
  Description of Artificial Sequence: Synthetic oligonucleotide
ccaagaggagtacgtccgcttcgacag

SEQ ID NO: 415854 - DNA, 27 bp, Artificial Sequence
  Description of Artificial Sequence: Synthetic oligonucleotide
caagaggagtacgtccgcttcgacagc

SEQ ID NO: 415855 - DNA, 27 bp, Artificial Sequence
  Description of Artificial Sequence: Synthetic oligonucleotide
aagaggagtacgtccgcttcgacagcg

SEQ ID NO: 415856 - DNA, 27 bp, Artificial Sequence
  Description of Artificial Sequence: Synthetic oligonucleotide
agaggagtacgtccgcttcgacagcga

SEQ ID NO: 415857 - DNA, 26 bp, Artificial Sequence
  Description of Artificial Sequence: Synthetic oligonucleotide
gaggagtacgtccgcttcgacagcga

SEQ ID NO: 415858 - DNA, 26 bp, Artificial Sequence
  Description of Artificial Sequence: Synthetic oligonucleotide
aggagtacgtccgcttcgacagcgac

SEQ ID NO: 415859 - DNA, 25 bp, Artificial Sequence
  Description of Artificial Sequence: Synthetic oligonucleotide
ggagtacgtccgcttcgacagcgac

SEQ ID NO: 415860 - DNA, 26 bp, Artificial Sequence
  Description of Artificial Sequence: Synthetic oligonucleotide
gagtacgtccgcttcgacagcgacgt

SEQ ID NO: 415861 - DNA, 26 bp, Artificial Sequence
  Description of Artificial Sequence: Synthetic oligonucleotide
agtacgtccgcttcgacagcgacgtg

SEQ ID NO: 415862 - DNA, 25 bp, Artificial Sequence
  Description of Artificial Sequence: Synthetic oligonucleotide
gtacgtccgcttcgacagcgacgtg

SEQ ID NO: 415863 - DNA, 25 bp, Artificial Sequence
  Description of Artificial Sequence: Synthetic oligonucleotide
tacgtccgcttcgacagcgacgtgg

SEQ ID NO: 415864 - DNA, 24 bp, Artificial Sequence
  Description of Artificial Sequence: Synthetic oligonucleotide
acgtccgcttcgacagcgacgtgg

SEQ ID NO: 415865 - DNA, 23 bp, Artificial Sequence
  Description of Artificial Sequence: Synthetic oligonucleotide
cgtccgcttcgacagcgacgtgg

SEQ ID NO: 415866 - DNA, 23 bp, Artificial Sequence
  Description of Artificial Sequence: Synthetic oligonucleotide
gtccgcttcgacagcgacgtggg

SEQ ID NO: 415867 - DNA, 23 bp, Artificial Sequence
  Description of Artificial Sequence: Synthetic oligonucleotide
tccgcttcgacagcgacgtgggg

SEQ ID NO: 415868 - DNA, 22 bp, Artificial Sequence
  Description of Artificial Sequence: Synthetic oligonucleotide
ccgcttcgacagcgacgtgggg

SEQ ID NO: 415869 - DNA, 30 bp, Artificial Sequence; identical to SEQ ID NO: 69646
  Description of Artificial Sequence: Synthetic oligonucleotide

SEQ ID NO: 415870 - DNA, 30 bp, Artificial Sequence; identical to SEQ ID NO: 69647
  Description of Artificial Sequence: Synthetic oligonucleotide

SEQ ID NO: 415871 - DNA, 31 bp, Artificial Sequence; identical to SEQ ID NO: 69648
  Description of Artificial Sequence: Synthetic oligonucleotide

SEQ ID NO: 415872 - DNA, 32 bp, Artificial Sequence
  Description of Artificial Sequence: Synthetic oligonucleotide
tgttatttcttcaatgggacggagcgggtgag

SEQ ID NO: 415873 - DNA, 31 bp, Artificial Sequence
  Description of Artificial Sequence: Synthetic oligonucleotide
gttatttcttcaatgggacggagcgggtgag

SEQ ID NO: 415874 - DNA, 31 bp, Artificial Sequence
  Description of Artificial Sequence: Synthetic oligonucleotide
ttatttcttcaatgggacggagcgggtgagg

SEQ ID NO: 415875 - DNA, 30 bp, Artificial Sequence
  Description of Artificial Sequence: Synthetic oligonucleotide
tatttcttcaatgggacggagcgggtgagg

SEQ ID NO: 415876 - DNA, 29 bp, Artificial Sequence
  Description of Artificial Sequence: Synthetic oligonucleotide
atttcttcaatgggacggagcgggtgagg

SEQ ID NO: 415877 - DNA, 28 bp, Artificial Sequence
  Description of Artificial Sequence: Synthetic oligonucleotide
tttcttcaatgggacggagcgggtgagg

SEQ ID NO: 415878 - DNA, 27 bp, Artificial Sequence
  Description of Artificial Sequence: Synthetic oligonucleotide
ttcttcaatgggacggagcgggtgagg

SEQ ID NO: 415879 - DNA, 27 bp, Artificial Sequence
  Description of Artificial Sequence: Synthetic oligonucleotide
tcttcaatgggacggagcgggtgaggt

SEQ ID NO: 415880 - DNA, 27 bp, Artificial Sequence
  Description of Artificial Sequence: Synthetic oligonucleotide
cttcaatgggacggagcgggtgaggtt

SEQ ID NO: 415881 - DNA, 27 bp, Artificial Sequence
  Description of Artificial Sequence: Synthetic oligonucleotide
ttcaatgggacggagcgggtgaggttc

SEQ ID NO: 415882 - DNA, 26 bp, Artificial Sequence
  Description of Artificial Sequence: Synthetic oligonucleotide
tcaatgggacggagcgggtgaggttc

SEQ ID NO: 415883 - DNA, 25 bp, Artificial Sequence
  Description of Artificial Sequence: Synthetic oligonucleotide
caatgggacggagcgggtgaggttc

SEQ ID NO: 415884 - DNA, 26 bp, Artificial Sequence
  Description of Artificial Sequence: Synthetic oligonucleotide
aatgggacggagcgggtgaggttcct

SEQ ID NO: 415885 - DNA, 25 bp, Artificial Sequence
  Description of Artificial Sequence: Synthetic oligonucleotide
atgggacggagcgggtgaggttcct

SEQ ID NO: 415886 - DNA, 24 bp, Artificial Sequence
  Description of Artificial Sequence: Synthetic oligonucleotide
tgggacggagcgggtgaggttcct

SEQ ID NO: 415887 - DNA, 23 bp, Artificial Sequence
  Description of Artificial Sequence: Synthetic oligonucleotide
gggacggagcgggtgaggttcct

SEQ ID NO: 415888 - DNA, 23 bp, Artificial Sequence
  Description of Artificial Sequence: Synthetic oligonucleotide
ggacggagcgggtgaggttcctg

SEQ ID NO: 415889 - DNA, 24 bp, Artificial Sequence
  Description of Artificial Sequence: Synthetic oligonucleotide
gacggagcgggtgaggttcctgga

SEQ ID NO: 415890 - DNA, 25 bp, Artificial Sequence
  Description of Artificial Sequence: Synthetic oligonucleotide
acggagcgggtgaggttcctggaca

SEQ ID NO: 415891 - DNA, 24 bp, Artificial Sequence
  Description of Artificial Sequence: Synthetic oligonucleotide
cggagcgggtgaggttcctggaca

SEQ ID NO: 415892 - DNA, 27 bp, Artificial Sequence
  Description of Artificial Sequence: Synthetic oligonucleotide
ggagcgggtgaggttcctggacagata

SEQ ID NO: 415893 - DNA, 27 bp, Artificial Sequence
  Description of Artificial Sequence: Synthetic oligonucleotide
gagcgggtgaggttcctggacagatac

SEQ ID NO: 415894 - DNA, 29 bp, Artificial Sequence
  Description of Artificial Sequence: Synthetic oligonucleotide
agcgggtgaggttcctggacagatacttc

SEQ ID NO: 415895 - DNA, 28 bp, Artificial Sequence
  Description of Artificial Sequence: Synthetic oligonucleotide
gcgggtgaggttcctggacagatacttc

SEQ ID NO: 415896 - DNA, 33 bp, Artificial Sequence
  Description of Artificial Sequence: Synthetic oligonucleotide
cgggtgaggttcctggacagatacttctataac

SEQ ID NO: 415897 - DNA, 33 bp, Artificial Sequence
  Description of Artificial Sequence: Synthetic oligonucleotide
gggtgaggttcctggacagatacttctataacc

SEQ ID NO: 415898 - DNA, 35 bp, Artificial Sequence
  Description of Artificial Sequence: Synthetic oligonucleotide
ggtgaggttcctggacagatacttctataaccaag

SEQ ID NO: 415899 - DNA, 36 bp, Artificial Sequence
  Description of Artificial Sequence: Synthetic oligonucleotide
gtgaggttcctggacagatacttctataaccaagag

SEQ ID NO: 415900 - DNA, 36 bp, Artificial Sequence
  Description of Artificial Sequence: Synthetic oligonucleotide
tgaggttcctggacagatacttctataaccaagagg

SEQ ID NO: 415901 - DNA, 35 bp, Artificial Sequence
  Description of Artificial Sequence: Synthetic oligonucleotide
gaggttcctggacagatacttctataaccaagagg

SEQ ID NO: 415902 - DNA, 36 bp, Artificial Sequence
  Description of Artificial Sequence: Synthetic oligonucleotide
aggttcctggacagatacttctataaccaagaggag

SEQ ID NO: 415903 - DNA, 23 bp, Artificial Sequence
  Description of Artificial Sequence: Synthetic oligonucleotide
tgacggagctggggcggcctgtt

SEQ ID NO: 415904 - DNA, 22 bp, Artificial Sequence
  Description of Artificial Sequence: Synthetic oligonucleotide
gacggagctggggcggcctgtt

SEQ ID NO: 415905 - DNA, 22 bp, Artificial Sequence
  Description of Artificial Sequence: Synthetic oligonucleotide
acggagctggggcggcctgttg

SEQ ID NO: 415906 - DNA, 21 bp, Artificial Sequence
  Description of Artificial Sequence: Synthetic oligonucleotide
cggagctggggcggcctgttg

SEQ ID NO: 415907 - DNA, 21 bp, Artificial Sequence
  Description of Artificial Sequence: Synthetic oligonucleotide
ggagctggggcggcctgttgc

SEQ ID NO: 415908 - DNA, 21 bp, Artificial Sequence
  Description of Artificial Sequence: Synthetic oligonucleotide
gagctggggcggcctgttgcc

SEQ ID NO: 415909 - DNA, 22 bp, Artificial Sequence
  Description of Artificial Sequence: Synthetic oligonucleotide
agctggggcggcctgttgccga

SEQ ID NO: 415910 - DNA, 21 bp, Artificial Sequence
  Description of Artificial Sequence: Synthetic oligonucleotide
gctggggcggcctgttgccga

SEQ ID NO: 415911 - DNA, 23 bp, Artificial Sequence
  Description of Artificial Sequence: Synthetic oligonucleotide
ctggggcggcctgttgccgagta

SEQ ID NO: 415912 - DNA, 24 bp, Artificial Sequence
  Description of Artificial Sequence: Synthetic oligonucleotide
tggggcggcctgttgccgagtact

SEQ ID NO: 415913 - DNA, 29 bp, Artificial Sequence
  Description of Artificial Sequence: Synthetic oligonucleotide
ttgccgagtactggaacagccagaaggac

SEQ ID NO: 415914 - DNA, 27 bp, Artificial Sequence
  Description of Artificial Sequence: Synthetic oligonucleotide
cggagcactggaacagccagaaggact

SEQ ID NO: 415915 - DNA, 28 bp, Artificial Sequence
  Description of Artificial Sequence: Synthetic oligonucleotide
ggagcactggaacagccagaaggacttc

SEQ ID NO: 415916 - DNA, 28 bp, Artificial Sequence
  Description of Artificial Sequence: Synthetic oligonucleotide
gagcactggaacagccagaaggacttcc

SEQ ID NO: 415917 - DNA, 29 bp, Artificial Sequence
  Description of Artificial Sequence: Synthetic oligonucleotide
agcactggaacagccagaaggacttcctg

SEQ ID NO: 415918 - DNA, 28 bp, Artificial Sequence
  Description of Artificial Sequence: Synthetic oligonucleotide
gcactggaacagccagaaggacttcctg

SEQ ID NO: 415919 - DNA, 28 bp, Artificial Sequence
  Description of Artificial Sequence: Synthetic oligonucleotide
cactggaacagccagaaggacttcctgg

SEQ ID NO: 415920 - DNA, 20 bp, Artificial Sequence
  Description of Artificial Sequence: Synthetic oligonucleotide
agctggggcggcctgctgcc

SEQ ID NO: 415921 - DNA, 20 bp, Artificial Sequence
  Description of Artificial Sequence: Synthetic oligonucleotide
gctggggcggcctgctgcct

SEQ ID NO: 415922 - DNA, 20 bp, Artificial Sequence
  Description of Artificial Sequence: Synthetic oligonucleotide
ctggggcggcctgctgccga

SEQ ID NO: 415923 - DNA, 22 bp, Artificial Sequence
  Description of Artificial Sequence: Synthetic oligonucleotide
tggggcggcctgctgccgagta

SEQ ID NO: 415924 - DNA, 21 bp, Artificial Sequence
  Description of Artificial Sequence: Synthetic oligonucleotide
ggggcggcctgctgccgagta

SEQ ID NO: 415925 - DNA, 22 bp, Artificial Sequence
  Description of Artificial Sequence: Synthetic oligonucleotide
gggcggcctgctgccgagtact

SEQ ID NO: 415926 - DNA, 22 bp, Artificial Sequence
  Description of Artificial Sequence: Synthetic oligonucleotide
ggcggcctgctgccgagtactg

SEQ ID NO: 415927 - DNA, 24 bp, Artificial Sequence
  Description of Artificial Sequence: Synthetic oligonucleotide
gcggcctgctgccgagtactggaa

SEQ ID NO: 415928 - DNA, 25 bp, Artificial Sequence
  Description of Artificial Sequence: Synthetic oligonucleotide
cggcctgctgccgagtactggaaca

SEQ ID NO: 415929 - DNA, 25 bp, Artificial Sequence
  Description of Artificial Sequence: Synthetic oligonucleotide
ggcctgctgccgagtactggaacag

SEQ ID NO: 415930 - DNA, 25 bp, Artificial Sequence
  Description of Artificial Sequence: Synthetic oligonucleotide
gcctgctgccgagtactggaacagc

SEQ ID NO: 415931 - DNA, 26 bp, Artificial Sequence
  Description of Artificial Sequence: Synthetic oligonucleotide
cctgctgccgagtactggaacagcca

SEQ ID NO: 415932 - DNA, 27 bp, Artificial Sequence
  Description of Artificial Sequence: Synthetic oligonucleotide
ctgctgccgagtactggaacagccaga

SEQ ID NO: 415933 - DNA, 28 bp, Artificial Sequence
  Description of Artificial Sequence: Synthetic oligonucleotide
tgctgccgagtactggaacagccagaag

SEQ ID NO: 415934 - DNA, 27 bp, Artificial Sequence
  Description of Artificial Sequence: Synthetic oligonucleotide
gctgccgagtactggaacagccagaag

SEQ ID NO: 415935 - DNA, 27 bp, Artificial Sequence
  Description of Artificial Sequence: Synthetic oligonucleotide
ctgccgagtactggaacagccagaagg

SEQ ID NO: 415936 - DNA, 31 bp, Artificial Sequence; identical to SEQ ID NO: 69019
  Description of Artificial Sequence: Synthetic oligonucleotide

SEQ ID NO: 415937 - DNA, 37 bp, Artificial Sequence; identical to SEQ ID NO: 69020
  Description of Artificial Sequence: Synthetic oligonucleotide

SEQ ID NO: 415938 - DNA, 36 bp, Artificial Sequence; identical to SEQ ID NO: 69021
  Description of Artificial Sequence: Synthetic oligonucleotide

SEQ ID NO: 415939 - DNA, 38 bp, Artificial Sequence; identical to SEQ ID NO: 69022
  Description of Artificial Sequence: Synthetic oligonucleotide

SEQ ID NO: 415940 - DNA, 41 bp, Artificial Sequence; identical to SEQ ID NO: 69023
  Description of Artificial Sequence: Synthetic oligonucleotide

SEQ ID NO: 415941 - DNA, 40 bp, Artificial Sequence; identical to SEQ ID NO: 69024
  Description of Artificial Sequence: Synthetic oligonucleotide

SEQ ID NO: 415942 - DNA, 39 bp, Artificial Sequence; identical to SEQ ID NO: 69025
  Description of Artificial Sequence: Synthetic oligonucleotide

SEQ ID NO: 415943 - DNA, 38 bp, Artificial Sequence; identical to SEQ ID NO: 69026
  Description of Artificial Sequence: Synthetic oligonucleotide

SEQ ID NO: 415944 - DNA, 38 bp, Artificial Sequence; identical to SEQ ID NO: 69027
  Description of Artificial Sequence: Synthetic oligonucleotide

SEQ ID NO: 415945 - DNA, 37 bp, Artificial Sequence; identical to SEQ ID NO: 69028
  Description of Artificial Sequence: Synthetic oligonucleotide

SEQ ID NO: 415946 - DNA, 36 bp, Artificial Sequence; identical to SEQ ID NO: 69029
  Description of Artificial Sequence: Synthetic oligonucleotide

SEQ ID NO: 415947 - DNA, 36 bp, Artificial Sequence; identical to SEQ ID NO: 69030
  Description of Artificial Sequence: Synthetic oligonucleotide

SEQ ID NO: 415948 - DNA, 37 bp, Artificial Sequence; identical to SEQ ID NO: 69031
  Description of Artificial Sequence: Synthetic oligonucleotide

SEQ ID NO: 415949 - DNA, 36 bp, Artificial Sequence; identical to SEQ ID NO: 69032
  Description of Artificial Sequence: Synthetic oligonucleotide

SEQ ID NO: 415950 - DNA, 36 bp, Artificial Sequence; identical to SEQ ID NO: 69033
  Description of Artificial Sequence: Synthetic oligonucleotide

SEQ ID NO: 415951 - DNA, 35 bp, Artificial Sequence; identical to SEQ ID NO: 69034
  Description of Artificial Sequence: Synthetic oligonucleotide

SEQ ID NO: 415952 - DNA, 34 bp, Artificial Sequence; identical to SEQ ID NO: 69035
  Description of Artificial Sequence: Synthetic oligonucleotide

SEQ ID NO: 415953 - DNA, 34 bp, Artificial Sequence; identical to SEQ ID NO: 69036
  Description of Artificial Sequence: Synthetic oligonucleotide

SEQ ID NO: 415954 - DNA, 33 bp, Artificial Sequence; identical to SEQ ID NO: 69037
  Description of Artificial Sequence: Synthetic oligonucleotide

SEQ ID NO: 415955 - DNA, 34 bp, Artificial Sequence; identical to SEQ ID NO: 69038
  Description of Artificial Sequence: Synthetic oligonucleotide

SEQ ID NO: 415956 - DNA, 33 bp, Artificial Sequence; identical to SEQ ID NO: 69039
  Description of Artificial Sequence: Synthetic oligonucleotide

SEQ ID NO: 415957 - DNA, 32 bp, Artificial Sequence; identical to SEQ ID NO: 69040
  Description of Artificial Sequence: Synthetic oligonucleotide

SEQ ID NO: 415958 - DNA, 21 bp, Artificial Sequence
  Description of Artificial Sequence: Synthetic oligonucleotide
ctggggcggcctgatgcggag

SEQ ID NO: 415959 - DNA, 22 bp, Artificial Sequence
  Description of Artificial Sequence: Synthetic oligonucleotide
tggggcggcctgatgcggagca

SEQ ID NO: 415960 - DNA, 21 bp, Artificial Sequence
  Description of Artificial Sequence: Synthetic oligonucleotide
ggggcggcctgatgcggagca

SEQ ID NO: 415961 - DNA, 22 bp, Artificial Sequence
  Description of Artificial Sequence: Synthetic oligonucleotide
gggcggcctgatgcggagcact

SEQ ID NO: 415962 - DNA, 22 bp, Artificial Sequence
  Description of Artificial Sequence: Synthetic oligonucleotide
ggcggcctgatgcggagcactg

SEQ ID NO: 415963 - DNA, 24 bp, Artificial Sequence
  Description of Artificial Sequence: Synthetic oligonucleotide
gcggcctgatgcggagcactggaa

SEQ ID NO: 415964 - DNA, 25 bp, Artificial Sequence
  Description of Artificial Sequence: Synthetic oligonucleotide
cggcctgatgcggagcactggaaca

SEQ ID NO: 415965 - DNA, 25 bp, Artificial Sequence
  Description of Artificial Sequence: Synthetic oligonucleotide
ggcctgatgcggagcactggaacag

SEQ ID NO: 415966 - DNA, 25 bp, Artificial Sequence
  Description of Artificial Sequence: Synthetic oligonucleotide
gcctgatgcggagcactggaacagc

SEQ ID NO: 415967 - DNA, 26 bp, Artificial Sequence
  Description of Artificial Sequence: Synthetic oligonucleotide
cctgatgcggagcactggaacagcca

SEQ ID NO: 415968 - DNA, 27 bp, Artificial Sequence
  Description of Artificial Sequence: Synthetic oligonucleotide
ctgatgcggagcactggaacagccaga

SEQ ID NO: 415969 - DNA, 28 bp, Artificial Sequence
  Description of Artificial Sequence: Synthetic oligonucleotide
tgatgcggagcactggaacagccagaag

SEQ ID NO: 415970 - DNA, 27 bp, Artificial Sequence
  Description of Artificial Sequence: Synthetic oligonucleotide
gatgcggagcactggaacagccagaag

SEQ ID NO: 415971 - DNA, 27 bp, Artificial Sequence
  Description of Artificial Sequence: Synthetic oligonucleotide
atgcggagcactggaacagccagaagg

SEQ ID NO: 415972 - DNA, 27 bp, Artificial Sequence
  Description of Artificial Sequence: Synthetic oligonucleotide
cggagcactggaacagccagaaggaca

SEQ ID NO: 415973 - DNA, 28 bp, Artificial Sequence
  Description of Artificial Sequence: Synthetic oligonucleotide
ggagcactggaacagccagaaggacatc

SEQ ID NO: 415974 - DNA, 28 bp, Artificial Sequence
  Description of Artificial Sequence: Synthetic oligonucleotide
gagcactggaacagccagaaggacatcc

SEQ ID NO: 415975 - DNA, 29 bp, Artificial Sequence
  Description of Artificial Sequence: Synthetic oligonucleotide
agcactggaacagccagaaggacatcctg

SEQ ID NO: 415976 - DNA, 28 bp, Artificial Sequence
  Description of Artificial Sequence: Synthetic oligonucleotide
gcactggaacagccagaaggacatcctg

SEQ ID NO: 415977 - DNA, 28 bp, Artificial Sequence
  Description of Artificial Sequence: Synthetic oligonucleotide
cactggaacagccagaaggacatcctgg

SEQ ID NO: 415978 - DNA, 35 bp, Artificial Sequence; identical to SEQ ID NO: 69061
  Description of Artificial Sequence: Synthetic oligonucleotide

SEQ ID NO: 415979 - DNA, 36 bp, Artificial Sequence; identical to SEQ ID NO: 69062
  Description of Artificial Sequence: Synthetic oligonucleotide

SEQ ID NO: 415980 - DNA, 35 bp, Artificial Sequence; identical to SEQ ID NO: 69063
  Description of Artificial Sequence: Synthetic oligonucleotide

SEQ ID NO: 415981 - DNA, 34 bp, Artificial Sequence; identical to SEQ ID NO: 69064
  Description of Artificial Sequence: Synthetic oligonucleotide

SEQ ID NO: 415982 - DNA, 34 bp, Artificial Sequence; identical to SEQ ID NO: 69065
  Description of Artificial Sequence: Synthetic oligonucleotide

SEQ ID NO: 415983 - DNA, 35 bp, Artificial Sequence; identical to SEQ ID NO: 69066
  Description of Artificial Sequence: Synthetic oligonucleotide

SEQ ID NO: 415984 - DNA, 34 bp, Artificial Sequence; identical to SEQ ID NO: 69067
  Description of Artificial Sequence: Synthetic oligonucleotide

SEQ ID NO: 415985 - DNA, 34 bp, Artificial Sequence; identical to SEQ ID NO: 69068
  Description of Artificial Sequence: Synthetic oligonucleotide

SEQ ID NO: 415986 - DNA, 34 bp, Artificial Sequence; identical to SEQ ID NO: 69069
  Description of Artificial Sequence: Synthetic oligonucleotide

SEQ ID NO: 415987 - DNA, 33 bp, Artificial Sequence; identical to SEQ ID NO: 69070
  Description of Artificial Sequence: Synthetic oligonucleotide

SEQ ID NO: 415988 - DNA, 33 bp, Artificial Sequence; identical to SEQ ID NO: 69071
  Description of Artificial Sequence: Synthetic oligonucleotide

SEQ ID NO: 415989 - DNA, 32 bp, Artificial Sequence; identical to SEQ ID NO: 69072
  Description of Artificial Sequence: Synthetic oligonucleotide

SEQ ID NO: 415990 - DNA, 34 bp, Artificial Sequence; identical to SEQ ID NO: 69073
  Description of Artificial Sequence: Synthetic oligonucleotide

SEQ ID NO: 415991 - DNA, 33 bp, Artificial Sequence; identical to SEQ ID NO: 69074
  Description of Artificial Sequence: Synthetic oligonucleotide

SEQ ID NO: 415992 - DNA, 32 bp, Artificial Sequence; identical to SEQ ID NO: 69075
  Description of Artificial Sequence: Synthetic oligonucleotide

SEQ ID NO: 415993 - DNA, 31 bp, Artificial Sequence; identical to SEQ ID NO: 69076
  Description of Artificial Sequence: Synthetic oligonucleotide

SEQ ID NO: 415994 - DNA, 31 bp, Artificial Sequence; identical to SEQ ID NO: 69077
  Description of Artificial Sequence: Synthetic oligonucleotide

SEQ ID NO: 415995 - DNA, 30 bp, Artificial Sequence; identical to SEQ ID NO: 69078
  Description of Artificial Sequence: Synthetic oligonucleotide

SEQ ID NO: 415996 - DNA, 29 bp, Artificial Sequence
  Description of Artificial Sequence: Synthetic oligonucleotide
ctataaccaagaggaggacgtgcgcttcg

SEQ ID NO: 415997 - DNA, 30 bp, Artificial Sequence; identical to SEQ ID NO: 69080
  Description of Artificial Sequence: Synthetic oligonucleotide

SEQ ID NO: 415998 - DNA, 29 bp, Artificial Sequence
  Description of Artificial Sequence: Synthetic oligonucleotide
ataaccaagaggaggacgtgcgcttcgac

SEQ ID NO: 415999 - DNA, 28 bp, Artificial Sequence
  Description of Artificial Sequence: Synthetic oligonucleotide
taaccaagaggaggacgtgcgcttcgac

SEQ ID NO: 416000 - DNA, 27 bp, Artificial Sequence
  Description of Artificial Sequence: Synthetic oligonucleotide
aaccaagaggaggacgtgcgcttcgac

SEQ ID NO: 416001 - DNA, 27 bp, Artificial Sequence
  Description of Artificial Sequence: Synthetic oligonucleotide
accaagaggaggacgtgcgcttcgaca

SEQ ID NO: 416002 - DNA, 26 bp, Artificial Sequence
  Description of Artificial Sequence: Synthetic oligonucleotide
ccaagaggaggacgtgcgcttcgaca

SEQ ID NO: 416003 - DNA, 26 bp, Artificial Sequence
  Description of Artificial Sequence: Synthetic oligonucleotide
caagaggaggacgtgcgcttcgacag

SEQ ID NO: 416004 - DNA, 26 bp, Artificial Sequence
  Description of Artificial Sequence: Synthetic oligonucleotide
aagaggaggacgtgcgcttcgacagc

SEQ ID NO: 416005 - DNA, 24 bp, Artificial Sequence
  Description of Artificial Sequence: Synthetic oligonucleotide
acatcctggaagacaggcgggccg

SEQ ID NO: 416006 - DNA, 23 bp, Artificial Sequence
  Description of Artificial Sequence: Synthetic oligonucleotide
catcctggaagacaggcgggccg

SEQ ID NO: 416007 - DNA, 23 bp, Artificial Sequence
  Description of Artificial Sequence: Synthetic oligonucleotide
atcctggaagacaggcgggccgc

SEQ ID NO: 416008 - DNA, 23 bp, Artificial Sequence
  Description of Artificial Sequence: Synthetic oligonucleotide
gtgacggagctggggcggcctat

SEQ ID NO: 416009 - DNA, 23 bp, Artificial Sequence
  Description of Artificial Sequence: Synthetic oligonucleotide
tgacggagctggggcggcctatc

SEQ ID NO: 416010 - DNA, 22 bp, Artificial Sequence
  Description of Artificial Sequence: Synthetic oligonucleotide
gacggagctggggcggcctatc

SEQ ID NO: 416011 - DNA, 22 bp, Artificial Sequence
  Description of Artificial Sequence: Synthetic oligonucleotide
acggagctggggcggcctatcg

SEQ ID NO: 416012 - DNA, 21 bp, Artificial Sequence
  Description of Artificial Sequence: Synthetic oligonucleotide
cggagctggggcggcctatcg

SEQ ID NO: 416013 - DNA, 21 bp, Artificial Sequence
  Description of Artificial Sequence: Synthetic oligonucleotide
ggagctggggcggcctatcgc

SEQ ID NO: 416014 - DNA, 21 bp, Artificial Sequence
  Description of Artificial Sequence: Synthetic oligonucleotide
gagctggggcggcctatcgcc

SEQ ID NO: 416015 - DNA, 22 bp, Artificial Sequence
  Description of Artificial Sequence: Synthetic oligonucleotide
agctggggcggcctatcgccga

SEQ ID NO: 416016 - DNA, 21 bp, Artificial Sequence
  Description of Artificial Sequence: Synthetic oligonucleotide
gctggggcggcctatcgccga

SEQ ID NO: 416017 - DNA, 23 bp, Artificial Sequence
  Description of Artificial Sequence: Synthetic oligonucleotide
ctggggcggcctatcgccgagta

SEQ ID NO: 416018 - DNA, 24 bp, Artificial Sequence
  Description of Artificial Sequence: Synthetic oligonucleotide
tggggcggcctatcgccgagtact

SEQ ID NO: 416019 - DNA, 23 bp, Artificial Sequence
  Description of Artificial Sequence: Synthetic oligonucleotide
ggggcggcctatcgccgagtact

SEQ ID NO: 416020 - DNA, 23 bp, Artificial Sequence
  Description of Artificial Sequence: Synthetic oligonucleotide
gggcggcctatcgccgagtactg

SEQ ID NO: 416021 - DNA, 25 bp, Artificial Sequence
  Description of Artificial Sequence: Synthetic oligonucleotide
ggcggcctatcgccgagtactggaa

SEQ ID NO: 416022 - DNA, 26 bp, Artificial Sequence
  Description of Artificial Sequence: Synthetic oligonucleotide
gcggcctatcgccgagtactggaaca

SEQ ID NO: 416023 - DNA, 26 bp, Artificial Sequence
  Description of Artificial Sequence: Synthetic oligonucleotide
cggcctatcgccgagtactggaacag

SEQ ID NO: 416024 - DNA, 26 bp, Artificial Sequence
  Description of Artificial Sequence: Synthetic oligonucleotide
ggcctatcgccgagtactggaacagc

SEQ ID NO: 416025 - DNA, 27 bp, Artificial Sequence
  Description of Artificial Sequence: Synthetic oligonucleotide
gcctatcgccgagtactggaacagcca

SEQ ID NO: 416026 - DNA, 27 bp, Artificial Sequence
  Description of Artificial Sequence: Synthetic oligonucleotide
cctatcgccgagtactggaacagccag

SEQ ID NO: 416027 - DNA, 29 bp, Artificial Sequence
  Description of Artificial Sequence: Synthetic oligonucleotide
ctatcgccgagtactggaacagccagaag

SEQ ID NO: 416028 - DNA, 29 bp, Artificial Sequence
  Description of Artificial Sequence: Synthetic oligonucleotide
tatcgccgagtactggaacagccagaagg

SEQ ID NO: 416029 - DNA, 28 bp, Artificial Sequence
  Description of Artificial Sequence: Synthetic oligonucleotide
atcgccgagtactggaacagccagaagg

SEQ ID NO: 416030 - DNA, 38 bp, Artificial Sequence; identical to SEQ ID NO: 69113
  Description of Artificial Sequence: Synthetic oligonucleotide

SEQ ID NO: 416031 - DNA, 40 bp, Artificial Sequence; identical to SEQ ID NO: 69114
  Description of Artificial Sequence: Synthetic oligonucleotide

SEQ ID NO: 416032 - DNA, 39 bp, Artificial Sequence; identical to SEQ ID NO: 69115
  Description of Artificial Sequence: Synthetic oligonucleotide

SEQ ID NO: 416033 - DNA, 42 bp, Artificial Sequence; identical to SEQ ID NO: 69116
  Description of Artificial Sequence: Synthetic oligonucleotide

SEQ ID NO: 416034 - DNA, 42 bp, Artificial Sequence; identical to SEQ ID NO: 69117
  Description of Artificial Sequence: Synthetic oligonucleotide

SEQ ID NO: 416035 - DNA, 41 bp, Artificial Sequence; identical to SEQ ID NO: 69118
  Description of Artificial Sequence: Synthetic oligonucleotide

SEQ ID NO: 416036 - DNA, 40 bp, Artificial Sequence; identical to SEQ ID NO: 69119
  Description of Artificial Sequence: Synthetic oligonucleotide

SEQ ID NO: 416037 - DNA, 39 bp, Artificial Sequence; identical to SEQ ID NO: 69120
  Description of Artificial Sequence: Synthetic oligonucleotide

SEQ ID NO: 416038 - DNA, 39 bp, Artificial Sequence; identical to SEQ ID NO: 69121
  Description of Artificial Sequence: Synthetic oligonucleotide

SEQ ID NO: 416039 - DNA, 38 bp, Artificial Sequence; identical to SEQ ID NO: 69122
  Description of Artificial Sequence: Synthetic oligonucleotide

SEQ ID NO: 416040 - DNA, 37 bp, Artificial Sequence; identical to SEQ ID NO: 69123
  Description of Artificial Sequence: Synthetic oligonucleotide

SEQ ID NO: 416041 - DNA, 38 bp, Artificial Sequence; identical to SEQ ID NO: 69124
  Description of Artificial Sequence: Synthetic oligonucleotide

SEQ ID NO: 416042 - DNA, 38 bp, Artificial Sequence; identical to SEQ ID NO: 69125
  Description of Artificial Sequence: Synthetic oligonucleotide

SEQ ID NO: 416043 - DNA, 37 bp, Artificial Sequence; identical to SEQ ID NO: 69126
  Description of Artificial Sequence: Synthetic oligonucleotide

SEQ ID NO: 416044 - DNA, 37 bp, Artificial Sequence; identical to SEQ ID NO: 69127
  Description of Artificial Sequence: Synthetic oligonucleotide

SEQ ID NO: 416045 - DNA, 36 bp, Artificial Sequence; identical to SEQ ID NO: 69128
  Description of Artificial Sequence: Synthetic oligonucleotide

SEQ ID NO: 416046 - DNA, 35 bp, Artificial Sequence; identical to SEQ ID NO: 69129
  Description of Artificial Sequence: Synthetic oligonucleotide

SEQ ID NO: 416047 - DNA, 36 bp, Artificial Sequence; identical to SEQ ID NO: 69130
  Description of Artificial Sequence: Synthetic oligonucleotide

SEQ ID NO: 416048 - DNA, 35 bp, Artificial Sequence; identical to SEQ ID NO: 69131
  Description of Artificial Sequence: Synthetic oligonucleotide

SEQ ID NO: 416049 - DNA, 35 bp, Artificial Sequence; identical to SEQ ID NO: 69132
  Description of Artificial Sequence: Synthetic oligonucleotide

SEQ ID NO: 416050 - DNA, 34 bp, Artificial Sequence; identical to SEQ ID NO: 69133
  Description of Artificial Sequence: Synthetic oligonucleotide

SEQ ID NO: 416051 - DNA, 33 bp, Artificial Sequence; identical to SEQ ID NO: 69134
  Description of Artificial Sequence: Synthetic oligonucleotide

SEQ ID NO: 416052 - DNA, 27 bp, Artificial Sequence
  Description of Artificial Sequence: Synthetic oligonucleotide
aactacggggctgtggagagcttcacg

SEQ ID NO: 416053 - DNA, 26 bp, Artificial Sequence
  Description of Artificial Sequence: Synthetic oligonucleotide
actacggggctgtggagagcttcacg

SEQ ID NO: 416054 - DNA, 25 bp, Artificial Sequence
  Description of Artificial Sequence: Synthetic oligonucleotide
ctacggggctgtggagagcttcacg

SEQ ID NO: 416055 - DNA, 26 bp, Artificial Sequence
  Description of Artificial Sequence: Synthetic oligonucleotide
tacggggctgtggagagcttcacggt

SEQ ID NO: 416056 - DNA, 25 bp, Artificial Sequence
  Description of Artificial Sequence: Synthetic oligonucleotide
acggggctgtggagagcttcacggt

SEQ ID NO: 416057 - DNA, 24 bp, Artificial Sequence
  Description of Artificial Sequence: Synthetic oligonucleotide
cggggctgtggagagcttcacggt

SEQ ID NO: 416058 - DNA, 24 bp, Artificial Sequence
  Description of Artificial Sequence: Synthetic oligonucleotide
ggggctgtggagagcttcacggtg

SEQ ID NO: 416059 - DNA, 25 bp, Artificial Sequence
  Description of Artificial Sequence: Synthetic oligonucleotide
gggctgtggagagcttcacggtgca

SEQ ID NO: 416060 - DNA, 25 bp, Artificial Sequence
  Description of Artificial Sequence: Synthetic oligonucleotide
ggctgtggagagcttcacggtgcag

SEQ ID NO: 416061 - DNA, 25 bp, Artificial Sequence
  Description of Artificial Sequence: Synthetic oligonucleotide
gctgtggagagcttcacggtgcagc

SEQ ID NO: 416062 - DNA, 25 bp, Artificial Sequence
  Description of Artificial Sequence: Synthetic oligonucleotide
ctgtggagagcttcacggtgcagcg

SEQ ID NO: 416063 - DNA, 27 bp, Artificial Sequence
  Description of Artificial Sequence: Synthetic oligonucleotide
agtacgtgcgcttcgacagcgacgtga

SEQ ID NO: 416064 - DNA, 26 bp, Artificial Sequence
  Description of Artificial Sequence: Synthetic oligonucleotide
gtacgtgcgcttcgacagcgacgtga

SEQ ID NO: 416065 - DNA, 26 bp, Artificial Sequence
  Description of Artificial Sequence: Synthetic oligonucleotide
tacgtgcgcttcgacagcgacgtgag

SEQ ID NO: 416066 - DNA, 25 bp, Artificial Sequence
  Description of Artificial Sequence: Synthetic oligonucleotide
acgtgcgcttcgacagcgacgtgag

SEQ ID NO: 416067 - DNA, 31 bp, Artificial Sequence; identical to SEQ ID NO: 69150
  Description of Artificial Sequence: Synthetic oligonucleotide

SEQ ID NO: 416068 - DNA, 30 bp, Artificial Sequence; identical to SEQ ID NO: 69151
  Description of Artificial Sequence: Synthetic oligonucleotide

SEQ ID NO: 416069 - DNA, 29 bp, Artificial Sequence
  Description of Artificial Sequence: Synthetic oligonucleotide
atttcttcaatgggacggagcgggtgctg

SEQ ID NO: 416070 - DNA, 28 bp, Artificial Sequence
  Description of Artificial Sequence: Synthetic oligonucleotide
tttcttcaatgggacggagcgggtgctg

SEQ ID NO: 416071 - DNA, 27 bp, Artificial Sequence
  Description of Artificial Sequence: Synthetic oligonucleotide
ttcttcaatgggacggagcgggtgctg

SEQ ID NO: 416072 - DNA, 27 bp, Artificial Sequence
  Description of Artificial Sequence: Synthetic oligonucleotide
tcttcaatgggacggagcgggtgctgt

SEQ ID NO: 416073 - DNA, 27 bp, Artificial Sequence
  Description of Artificial Sequence: Synthetic oligonucleotide
cttcaatgggacggagcgggtgctgtt

SEQ ID NO: 416074 - DNA, 27 bp, Artificial Sequence
  Description of Artificial Sequence: Synthetic oligonucleotide
ttcaatgggacggagcgggtgctgttc

SEQ ID NO: 416075 - DNA, 26 bp, Artificial Sequence
  Description of Artificial Sequence: Synthetic oligonucleotide
tcaatgggacggagcgggtgctgttc

SEQ ID NO: 416076 - DNA, 25 bp, Artificial Sequence
  Description of Artificial Sequence: Synthetic oligonucleotide
caatgggacggagcgggtgctgttc

SEQ ID NO: 416077 - DNA, 26 bp, Artificial Sequence
  Description of Artificial Sequence: Synthetic oligonucleotide
aatgggacggagcgggtgctgttcct

SEQ ID NO: 416078 - DNA, 25 bp, Artificial Sequence
  Description of Artificial Sequence: Synthetic oligonucleotide
atgggacggagcgggtgctgttcct

SEQ ID NO: 416079 - DNA, 24 bp, Artificial Sequence
  Description of Artificial Sequence: Synthetic oligonucleotide
tgggacggagcgggtgctgttcct

SEQ ID NO: 416080 - DNA, 23 bp, Artificial Sequence
  Description of Artificial Sequence: Synthetic oligonucleotide
gggacggagcgggtgctgttcct

SEQ ID NO: 416081 - DNA, 23 bp, Artificial Sequence
  Description of Artificial Sequence: Synthetic oligonucleotide
ggacggagcgggtgctgttcctg

SEQ ID NO: 416082 - DNA, 24 bp, Artificial Sequence
  Description of Artificial Sequence: Synthetic oligonucleotide
gacggagcgggtgctgttcctgga

SEQ ID NO: 416083 - DNA, 25 bp, Artificial Sequence
  Description of Artificial Sequence: Synthetic oligonucleotide
acggagcgggtgctgttcctggaca

SEQ ID NO: 416084 - DNA, 24 bp, Artificial Sequence
  Description of Artificial Sequence: Synthetic oligonucleotide
cggagcgggtgctgttcctggaca

SEQ ID NO: 416085 - DNA, 27 bp, Artificial Sequence
  Description of Artificial Sequence: Synthetic oligonucleotide
ggagcgggtgctgttcctggacagata

SEQ ID NO: 416086 - DNA, 27 bp, Artificial Sequence
  Description of Artificial Sequence: Synthetic oligonucleotide
gagcgggtgctgttcctggacagatac

SEQ ID NO: 416087 - DNA, 29 bp, Artificial Sequence
  Description of Artificial Sequence: Synthetic oligonucleotide
agcgggtgctgttcctggacagatacttc

SEQ ID NO: 416088 - DNA, 28 bp, Artificial Sequence
  Description of Artificial Sequence: Synthetic oligonucleotide
gcgggtgctgttcctggacagatacttc

SEQ ID NO: 416089 - DNA, 33 bp, Artificial Sequence; identical to SEQ ID NO: 69172
  Description of Artificial Sequence: Synthetic oligonucleotide

SEQ ID NO: 416090 - DNA, 33 bp, Artificial Sequence; identical to SEQ ID NO: 69173
  Description of Artificial Sequence: Synthetic oligonucleotide

SEQ ID NO: 416091 - DNA, 35 bp, Artificial Sequence; identical to SEQ ID NO: 69174
  Description of Artificial Sequence: Synthetic oligonucleotide

SEQ ID NO: 416092 - DNA, 36 bp, Artificial Sequence; identical to SEQ ID NO: 69175
  Description of Artificial Sequence: Synthetic oligonucleotide

SEQ ID NO: 416093 - DNA, 36 bp, Artificial Sequence; identical to SEQ ID NO: 69176
  Description of Artificial Sequence: Synthetic oligonucleotide

SEQ ID NO: 416094 - DNA, 35 bp, Artificial Sequence; identical to SEQ ID NO: 69177
  Description of Artificial Sequence: Synthetic oligonucleotide

SEQ ID NO: 416095 - DNA, 36 bp, Artificial Sequence; identical to SEQ ID NO: 69178
  Description of Artificial Sequence: Synthetic oligonucleotide

SEQ ID NO: 416096 - DNA, 38 bp, Artificial Sequence; identical to SEQ ID NO: 69179
  Description of Artificial Sequence: Synthetic oligonucleotide

SEQ ID NO: 416097 - DNA, 32 bp, Artificial Sequence; identical to SEQ ID NO: 69180
  Description of Artificial Sequence: Synthetic oligonucleotide

SEQ ID NO: 416098 - DNA, 33 bp, Artificial Sequence; identical to SEQ ID NO: 69181
  Description of Artificial Sequence: Synthetic oligonucleotide

SEQ ID NO: 416099 - DNA, 32 bp, Artificial Sequence; identical to SEQ ID NO: 69182
  Description of Artificial Sequence: Synthetic oligonucleotide

SEQ ID NO: 416100 - DNA, 33 bp, Artificial Sequence; identical to SEQ ID NO: 69183
  Description of Artificial Sequence: Synthetic oligonucleotide

SEQ ID NO: 416101 - DNA, 33 bp, Artificial Sequence; identical to SEQ ID NO: 69184
  Description of Artificial Sequence: Synthetic oligonucleotide

SEQ ID NO: 416102 - DNA, 34 bp, Artificial Sequence; identical to SEQ ID NO: 69185
  Description of Artificial Sequence: Synthetic oligonucleotide

SEQ ID NO: 416103 - DNA, 36 bp, Artificial Sequence; identical to SEQ ID NO: 69186
  Description of Artificial Sequence: Synthetic oligonucleotide

SEQ ID NO: 416104 - DNA, 35 bp, Artificial Sequence; identical to SEQ ID NO: 69187
  Description of Artificial Sequence: Synthetic oligonucleotide

SEQ ID NO: 416105 - DNA, 34 bp, Artificial Sequence; identical to SEQ ID NO: 69188
  Description of Artificial Sequence: Synthetic oligonucleotide

SEQ ID NO: 416106 - DNA, 34 bp, Artificial Sequence; identical to SEQ ID NO: 69189
  Description of Artificial Sequence: Synthetic oligonucleotide

SEQ ID NO: 416107 - DNA, 35 bp, Artificial Sequence; identical to SEQ ID NO: 69190
  Description of Artificial Sequence: Synthetic oligonucleotide

SEQ ID NO: 416108 - DNA, 34 bp, Artificial Sequence; identical to SEQ ID NO: 69191
  Description of Artificial Sequence: Synthetic oligonucleotide

SEQ ID NO: 416109 - DNA, 34 bp, Artificial Sequence; identical to SEQ ID NO: 69192
  Description of Artificial Sequence: Synthetic oligonucleotide

SEQ ID NO: 416110 - DNA, 34 bp, Artificial Sequence; identical to SEQ ID NO: 69193
  Description of Artificial Sequence: Synthetic oligonucleotide

SEQ ID NO: 416111 - DNA, 33 bp, Artificial Sequence; identical to SEQ ID NO: 69194
  Description of Artificial Sequence: Synthetic oligonucleotide

SEQ ID NO: 416112 - DNA, 33 bp, Artificial Sequence; identical to SEQ ID NO: 69195
  Description of Artificial Sequence: Synthetic oligonucleotide

SEQ ID NO: 416113 - DNA, 32 bp, Artificial Sequence; identical to SEQ ID NO: 69196
  Description of Artificial Sequence: Synthetic oligonucleotide

SEQ ID NO: 416114 - DNA, 34 bp, Artificial Sequence; identical to SEQ ID NO: 69197
  Description of Artificial Sequence: Synthetic oligonucleotide

SEQ ID NO: 416115 - DNA, 33 bp, Artificial Sequence; identical to SEQ ID NO: 69198
  Description of Artificial Sequence: Synthetic oligonucleotide

SEQ ID NO: 416116 - DNA, 32 bp, Artificial Sequence; identical to SEQ ID NO: 69199
  Description of Artificial Sequence: Synthetic oligonucleotide

SEQ ID NO: 416117 - DNA, 31 bp, Artificial Sequence; identical to SEQ ID NO: 69200
  Description of Artificial Sequence: Synthetic oligonucleotide

SEQ ID NO: 416118 - DNA, 31 bp, Artificial Sequence; identical to SEQ ID NO: 69201
  Description of Artificial Sequence: Synthetic oligonucleotide

SEQ ID NO: 416119 - DNA, 25 bp, Artificial Sequence
  Description of Artificial Sequence: Synthetic oligonucleotide
acatcctggaagacaggcgggccga

SEQ ID NO: 416120 - DNA, 24 bp, Artificial Sequence
  Description of Artificial Sequence: Synthetic oligonucleotide
catcctggaagacaggcgggccga

SEQ ID NO: 416121 - DNA, 24 bp, Artificial Sequence
  Description of Artificial Sequence: Synthetic oligonucleotide
atcctggaagacaggcgggccgag

SEQ ID NO: 416122 - DNA, 23 bp, Artificial Sequence
  Description of Artificial Sequence: Synthetic oligonucleotide
tcctggaagacaggcgggccgag

SEQ ID NO: 416123 - DNA, 22 bp, Artificial Sequence
  Description of Artificial Sequence: Synthetic oligonucleotide
cctggaagacaggcgggccgag

SEQ ID NO: 416124 - DNA, 23 bp, Artificial Sequence
  Description of Artificial Sequence: Synthetic oligonucleotide
ctggaagacaggcgggccgaggt

SEQ ID NO: 416125 - DNA, 23 bp, Artificial Sequence
  Description of Artificial Sequence: Synthetic oligonucleotide
tggaagacaggcgggccgaggtg

SEQ ID NO: 416126 - DNA, 22 bp, Artificial Sequence
  Description of Artificial Sequence: Synthetic oligonucleotide
ggaagacaggcgggccgaggtg

SEQ ID NO: 416127 - DNA, 23 bp, Artificial Sequence
  Description of Artificial Sequence: Synthetic oligonucleotide
gaagacaggcgggccgaggtgga

SEQ ID NO: 416128 - DNA, 24 bp, Artificial Sequence
  Description of Artificial Sequence: Synthetic oligonucleotide
aagacaggcgggccgaggtggaca

SEQ ID NO: 416129 - DNA, 23 bp, Artificial Sequence
  Description of Artificial Sequence: Synthetic oligonucleotide
agacaggcgggccgaggtggaca

SEQ ID NO: 416130 - DNA, 22 bp, Artificial Sequence
  Description of Artificial Sequence: Synthetic oligonucleotide
gacaggcgggccgaggtggaca

SEQ ID NO: 416131 - DNA, 22 bp, Artificial Sequence
  Description of Artificial Sequence: Synthetic oligonucleotide
acaggcgggccgaggtggacac

SEQ ID NO: 416132 - DNA, 21 bp, Artificial Sequence
  Description of Artificial Sequence: Synthetic oligonucleotide
caggcgggccgaggtggacac

SEQ ID NO: 416133 - DNA, 32 bp, Artificial Sequence; identical to SEQ ID NO: 69216
  Description of Artificial Sequence: Synthetic oligonucleotide

SEQ ID NO: 416134 - DNA, 31 bp, Artificial Sequence; identical to SEQ ID NO: 69217
  Description of Artificial Sequence: Synthetic oligonucleotide

SEQ ID NO: 416135 - DNA, 27 bp, Artificial Sequence
  Description of Artificial Sequence: Synthetic oligonucleotide
ttcaatgggacggagcgggtgcggtta

SEQ ID NO: 416136 - DNA, 26 bp, Artificial Sequence
  Description of Artificial Sequence: Synthetic oligonucleotide
tcaatgggacggagcgggtgcggtta

SEQ ID NO: 416137 - DNA, 25 bp, Artificial Sequence
  Description of Artificial Sequence: Synthetic oligonucleotide
caatgggacggagcgggtgcggtta

SEQ ID NO: 416138 - DNA, 26 bp, Artificial Sequence
  Description of Artificial Sequence: Synthetic oligonucleotide
aatgggacggagcgggtgcggttact

SEQ ID NO: 416139 - DNA, 25 bp, Artificial Sequence
  Description of Artificial Sequence: Synthetic oligonucleotide
atgggacggagcgggtgcggttact

SEQ ID NO: 416140 - DNA, 24 bp, Artificial Sequence
  Description of Artificial Sequence: Synthetic oligonucleotide
tgggacggagcgggtgcggttact

SEQ ID NO: 416141 - DNA, 23 bp, Artificial Sequence
  Description of Artificial Sequence: Synthetic oligonucleotide
gggacggagcgggtgcggttact

SEQ ID NO: 416142 - DNA, 23 bp, Artificial Sequence
  Description of Artificial Sequence: Synthetic oligonucleotide
ggacggagcgggtgcggttactg

SEQ ID NO: 416143 - DNA, 24 bp, Artificial Sequence
  Description of Artificial Sequence: Synthetic oligonucleotide
gacggagcgggtgcggttactgga

SEQ ID NO: 416144 - DNA, 25 bp, Artificial Sequence
  Description of Artificial Sequence: Synthetic oligonucleotide
acggagcgggtgcggttactggaga

SEQ ID NO: 416145 - DNA, 24 bp, Artificial Sequence
  Description of Artificial Sequence: Synthetic oligonucleotide
cggagcgggtgcggttactggaga

SEQ ID NO: 416146 - DNA, 25 bp, Artificial Sequence
  Description of Artificial Sequence: Synthetic oligonucleotide
ggagcgggtgcggttactggagaga

SEQ ID NO: 416147 - DNA, 26 bp, Artificial Sequence
  Description of Artificial Sequence: Synthetic oligonucleotide
gagcgggtgcggttactggagagaca

SEQ ID NO: 416148 - DNA, 27 bp, Artificial Sequence
  Description of Artificial Sequence: Synthetic oligonucleotide
agcgggtgcggttactggagagacact

SEQ ID NO: 416149 - DNA, 27 bp, Artificial Sequence
  Description of Artificial Sequence: Synthetic oligonucleotide
gcgggtgcggttactggagagacactt

SEQ ID NO: 416150 - DNA, 27 bp, Artificial Sequence
  Description of Artificial Sequence: Synthetic oligonucleotide
cgggtgcggttactggagagacacttc

SEQ ID NO: 416151 - DNA, 27 bp, Artificial Sequence
  Description of Artificial Sequence: Synthetic oligonucleotide
gggtgcggttactggagagacacttcc

SEQ ID NO: 416152 - DNA, 31 bp, Artificial Sequence; identical to SEQ ID NO: 69235
  Description of Artificial Sequence: Synthetic oligonucleotide

SEQ ID NO: 416153 - DNA, 31 bp, Artificial Sequence; identical to SEQ ID NO: 69236
  Description of Artificial Sequence: Synthetic oligonucleotide

SEQ ID NO: 416154 - DNA, 32 bp, Artificial Sequence; identical to SEQ ID NO: 69237
  Description of Artificial Sequence: Synthetic oligonucleotide

SEQ ID NO: 416155 - DNA, 31 bp, Artificial Sequence; identical to SEQ ID NO: 69238
  Description of Artificial Sequence: Synthetic oligonucleotide

SEQ ID NO: 416156 - DNA, 31 bp, Artificial Sequence; identical to SEQ ID NO: 69239
  Description of Artificial Sequence: Synthetic oligonucleotide

SEQ ID NO: 416157 - DNA, 32 bp, Artificial Sequence; identical to SEQ ID NO: 69240
  Description of Artificial Sequence: Synthetic oligonucleotide

SEQ ID NO: 416158 - DNA, 32 bp, Artificial Sequence; identical to SEQ ID NO: 69241
  Description of Artificial Sequence: Synthetic oligonucleotide

SEQ ID NO: 416159 - DNA, 33 bp, Artificial Sequence; identical to SEQ ID NO: 69242
  Description of Artificial Sequence: Synthetic oligonucleotide

SEQ ID NO: 416160 - DNA, 32 bp, Artificial Sequence; identical to SEQ ID NO: 69243
  Description of Artificial Sequence: Synthetic oligonucleotide

SEQ ID NO: 416161 - DNA, 31 bp, Artificial Sequence; identical to SEQ ID NO: 69244
  Description of Artificial Sequence: Synthetic oligonucleotide

SEQ ID NO: 416162 - DNA, 30 bp, Artificial Sequence; identical to SEQ ID NO: 69245
  Description of Artificial Sequence: Synthetic oligonucleotide

SEQ ID NO: 416163 - DNA, 30 bp, Artificial Sequence; identical to SEQ ID NO: 69246
  Description of Artificial Sequence: Synthetic oligonucleotide

SEQ ID NO: 416164 - DNA, 29 bp, Artificial Sequence
  Description of Artificial Sequence: Synthetic oligonucleotide
ggagagacacttccataaccaggaggagc

SEQ ID NO: 416165 - DNA, 30 bp, Artificial Sequence; identical to SEQ ID NO: 69248
  Description of Artificial Sequence: Synthetic oligonucleotide

SEQ ID NO: 416166 - DNA, 30 bp, Artificial Sequence; identical to SEQ ID NO: 69249
  Description of Artificial Sequence: Synthetic oligonucleotide

SEQ ID NO: 416167 - DNA, 29 bp, Artificial Sequence
  Description of Artificial Sequence: Synthetic oligonucleotide
gagacacttccataaccaggaggagctcc

SEQ ID NO: 416168 - DNA, 30 bp, Artificial Sequence; identical to SEQ ID NO: 69251
  Description of Artificial Sequence: Synthetic oligonucleotide

SEQ ID NO: 416169 - DNA, 29 bp, Artificial Sequence
  Description of Artificial Sequence: Synthetic oligonucleotide
gacacttccataaccaggaggagctcctg

SEQ ID NO: 416170 - DNA, 29 bp, Artificial Sequence
  Description of Artificial Sequence: Synthetic oligonucleotide
acacttccataaccaggaggagctcctgc

SEQ ID NO: 416171 - DNA, 28 bp, Artificial Sequence
  Description of Artificial Sequence: Synthetic oligonucleotide
cacttccataaccaggaggagctcctgc

SEQ ID NO: 416172 - DNA, 28 bp, Artificial Sequence
  Description of Artificial Sequence: Synthetic oligonucleotide
acttccataaccaggaggagctcctgcg

SEQ ID NO: 416173 - DNA, 27 bp, Artificial Sequence
  Description of Artificial Sequence: Synthetic oligonucleotide
cttccataaccaggaggagctcctgcg

SEQ ID NO: 416174 - DNA, 27 bp, Artificial Sequence
  Description of Artificial Sequence: Synthetic oligonucleotide
ttccataaccaggaggagctcctgcgc

SEQ ID NO: 416175 - DNA, 27 bp, Artificial Sequence
  Description of Artificial Sequence: Synthetic oligonucleotide
tccataaccaggaggagctcctgcgct

SEQ ID NO: 416176 - DNA, 27 bp, Artificial Sequence
  Description of Artificial Sequence: Synthetic oligonucleotide
ccataaccaggaggagctcctgcgctt

SEQ ID NO: 416177 - DNA, 27 bp, Artificial Sequence
  Description of Artificial Sequence: Synthetic oligonucleotide
cataaccaggaggagctcctgcgcttc

SEQ ID NO: 416178 - DNA, 27 bp, Artificial Sequence
  Description of Artificial Sequence: Synthetic oligonucleotide
ataaccaggaggagctcctgcgcttcg

SEQ ID NO: 416179 - DNA, 27 bp, Artificial Sequence
  Description of Artificial Sequence: Synthetic oligonucleotide
taaccaggaggagctcctgcgcttcga

SEQ ID NO: 416180 - DNA, 26 bp, Artificial Sequence
  Description of Artificial Sequence: Synthetic oligonucleotide
aaccaggaggagctcctgcgcttcga

SEQ ID NO: 416181 - DNA, 25 bp, Artificial Sequence
  Description of Artificial Sequence: Synthetic oligonucleotide
accaggaggagctcctgcgcttcga

SEQ ID NO: 416182 - DNA, 24 bp, Artificial Sequence
  Description of Artificial Sequence: Synthetic oligonucleotide
ccaggaggagctcctgcgcttcga

SEQ ID NO: 416183 - DNA, 25 bp, Artificial Sequence
  Description of Artificial Sequence: Synthetic oligonucleotide
caggaggagctcctgcgcttcgaca

SEQ ID NO: 416184 - DNA, 25 bp, Artificial Sequence
  Description of Artificial Sequence: Synthetic oligonucleotide
aggaggagctcctgcgcttcgacag

SEQ ID NO: 416185 - DNA, 24 bp, Artificial Sequence
  Description of Artificial Sequence: Synthetic oligonucleotide
ggaggagctcctgcgcttcgacag

SEQ ID NO: 416186 - DNA, 24 bp, Artificial Sequence
  Description of Artificial Sequence: Synthetic oligonucleotide
gaggagctcctgcgcttcgacagc

SEQ ID NO: 416187 - DNA, 25 bp, Artificial Sequence
  Description of Artificial Sequence: Synthetic oligonucleotide
aggagctcctgcgcttcgacagcga

SEQ ID NO: 416188 - DNA, 24 bp, Artificial Sequence
  Description of Artificial Sequence: Synthetic oligonucleotide
ggagctcctgcgcttcgacagcga

SEQ ID NO: 416189 - DNA, 24 bp, Artificial Sequence
  Description of Artificial Sequence: Synthetic oligonucleotide
gagctcctgcgcttcgacagcgac

SEQ ID NO: 416190 - DNA, 25 bp, Artificial Sequence
  Description of Artificial Sequence: Synthetic oligonucleotide
agctcctgcgcttcgacagcgacgt

SEQ ID NO: 416191 - DNA, 24 bp, Artificial Sequence
  Description of Artificial Sequence: Synthetic oligonucleotide
gctcctgcgcttcgacagcgacgt

SEQ ID NO: 416192 - DNA, 24 bp, Artificial Sequence
  Description of Artificial Sequence: Synthetic oligonucleotide
ctcctgcgcttcgacagcgacgtg

SEQ ID NO: 416193 - DNA, 26 bp, Artificial Sequence
  Description of Artificial Sequence: Synthetic oligonucleotide
cttcgacagcgacgtgggggagtact

SEQ ID NO: 416194 - DNA, 26 bp, Artificial Sequence
  Description of Artificial Sequence: Synthetic oligonucleotide
ttcgacagcgacgtgggggagtactg

SEQ ID NO: 416195 - DNA, 25 bp, Artificial Sequence
  Description of Artificial Sequence: Synthetic oligonucleotide
tcgacagcgacgtgggggagtactg

SEQ ID NO: 416196 - DNA, 24 bp, Artificial Sequence
  Description of Artificial Sequence: Synthetic oligonucleotide
cgacagcgacgtgggggagtactg

SEQ ID NO: 416197 - DNA, 24 bp, Artificial Sequence
  Description of Artificial Sequence: Synthetic oligonucleotide
gacagcgacgtgggggagtactgg

SEQ ID NO: 416198 - DNA, 24 bp, Artificial Sequence
  Description of Artificial Sequence: Synthetic oligonucleotide
acagcgacgtgggggagtactggg

SEQ ID NO: 416199 - DNA, 23 bp, Artificial Sequence
  Description of Artificial Sequence: Synthetic oligonucleotide
cagcgacgtgggggagtactggg

SEQ ID NO: 416200 - DNA, 23 bp, Artificial Sequence
  Description of Artificial Sequence: Synthetic oligonucleotide
agcgacgtgggggagtactgggc

SEQ ID NO: 416201 - DNA, 22 bp, Artificial Sequence
  Description of Artificial Sequence: Synthetic oligonucleotide
gcgacgtgggggagtactgggc

SEQ ID NO: 416202 - DNA, 22 bp, Artificial Sequence
  Description of Artificial Sequence: Synthetic oligonucleotide
cgacgtgggggagtactgggcg

SEQ ID NO: 416203 - DNA, 23 bp, Artificial Sequence
  Description of Artificial Sequence: Synthetic oligonucleotide
gacgtgggggagtactgggcggt

SEQ ID NO: 416204 - DNA, 24 bp, Artificial Sequence
  Description of Artificial Sequence: Synthetic oligonucleotide
acgtgggggagtactgggcggtga

SEQ ID NO: 416205 - DNA, 23 bp, Artificial Sequence
  Description of Artificial Sequence: Synthetic oligonucleotide
cgtgggggagtactgggcggtga

SEQ ID NO: 416206 - DNA, 23 bp, Artificial Sequence
  Description of Artificial Sequence: Synthetic oligonucleotide
gtgggggagtactgggcggtgac

SEQ ID NO: 416207 - DNA, 23 bp, Artificial Sequence
  Description of Artificial Sequence: Synthetic oligonucleotide
tgggggagtactgggcggtgacg

SEQ ID NO: 416208 - DNA, 22 bp, Artificial Sequence
  Description of Artificial Sequence: Synthetic oligonucleotide
gggggagtactgggcggtgacg

SEQ ID NO: 416209 - DNA, 23 bp, Artificial Sequence
  Description of Artificial Sequence: Synthetic oligonucleotide
ggggagtactgggcggtgacgga

SEQ ID NO: 416210 - DNA, 23 bp, Artificial Sequence
  Description of Artificial Sequence: Synthetic oligonucleotide
gggagtactgggcggtgacggag

SEQ ID NO: 416211 - DNA, 24 bp, Artificial Sequence
  Description of Artificial Sequence: Synthetic oligonucleotide
ggagtactgggcggtgacggagct

SEQ ID NO: 416212 - DNA, 24 bp, Artificial Sequence
  Description of Artificial Sequence: Synthetic oligonucleotide
gagtactgggcggtgacggagctg

SEQ ID NO: 416213 - DNA, 24 bp, Artificial Sequence
  Description of Artificial Sequence: Synthetic oligonucleotide
agtactgggcggtgacggagctgg

SEQ ID NO: 416214 - DNA, 23 bp, Artificial Sequence
  Description of Artificial Sequence: Synthetic oligonucleotide
gtactgggcggtgacggagctgg

SEQ ID NO: 416215 - DNA, 23 bp, Artificial Sequence
  Description of Artificial Sequence: Synthetic oligonucleotide
tactgggcggtgacggagctggg

SEQ ID NO: 416216 - DNA, 22 bp, Artificial Sequence
  Description of Artificial Sequence: Synthetic oligonucleotide
actgggcggtgacggagctggg

SEQ ID NO: 416217 - DNA, 33 bp, Artificial Sequence; identical to SEQ ID NO: 69300
  Description of Artificial Sequence: Synthetic oligonucleotide

SEQ ID NO: 416218 - DNA, 32 bp, Artificial Sequence; identical to SEQ ID NO: 69301
  Description of Artificial Sequence: Synthetic oligonucleotide

SEQ ID NO: 416219 - DNA, 33 bp, Artificial Sequence; identical to SEQ ID NO: 69302
  Description of Artificial Sequence: Synthetic oligonucleotide

SEQ ID NO: 416220 - DNA, 33 bp, Artificial Sequence; identical to SEQ ID NO: 69303
  Description of Artificial Sequence: Synthetic oligonucleotide

SEQ ID NO: 416221 - DNA, 34 bp, Artificial Sequence; identical to SEQ ID NO: 69304
  Description of Artificial Sequence: Synthetic oligonucleotide

SEQ ID NO: 416222 - DNA, 36 bp, Artificial Sequence; identical to SEQ ID NO: 69305
  Description of Artificial Sequence: Synthetic oligonucleotide

SEQ ID NO: 416223 - DNA, 35 bp, Artificial Sequence; identical to SEQ ID NO: 69306
  Description of Artificial Sequence: Synthetic oligonucleotide

SEQ ID NO: 416224 - DNA, 34 bp, Artificial Sequence; identical to SEQ ID NO: 69307
  Description of Artificial Sequence: Synthetic oligonucleotide

SEQ ID NO: 416225 - DNA, 34 bp, Artificial Sequence; identical to SEQ ID NO: 69308
  Description of Artificial Sequence: Synthetic oligonucleotide

SEQ ID NO: 416226 - DNA, 35 bp, Artificial Sequence; identical to SEQ ID NO: 69309
  Description of Artificial Sequence: Synthetic oligonucleotide

SEQ ID NO: 416227 - DNA, 34 bp, Artificial Sequence; identical to SEQ ID NO: 69310
  Description of Artificial Sequence: Synthetic oligonucleotide

SEQ ID NO: 416228 - DNA, 34 bp, Artificial Sequence; identical to SEQ ID NO: 69311
  Description of Artificial Sequence: Synthetic oligonucleotide

SEQ ID NO: 416229 - DNA, 34 bp, Artificial Sequence; identical to SEQ ID NO: 69312
  Description of Artificial Sequence: Synthetic oligonucleotide

SEQ ID NO: 416230 - DNA, 33 bp, Artificial Sequence; identical to SEQ ID NO: 69313
  Description of Artificial Sequence: Synthetic oligonucleotide

SEQ ID NO: 416231 - DNA, 33 bp, Artificial Sequence; identical to SEQ ID NO: 69314
  Description of Artificial Sequence: Synthetic oligonucleotide

SEQ ID NO: 416232 - DNA, 32 bp, Artificial Sequence; identical to SEQ ID NO: 69315
  Description of Artificial Sequence: Synthetic oligonucleotide

SEQ ID NO: 416233 - DNA, 34 bp, Artificial Sequence; identical to SEQ ID NO: 69316
  Description of Artificial Sequence: Synthetic oligonucleotide

SEQ ID NO: 416234 - DNA, 33 bp, Artificial Sequence; identical to SEQ ID NO: 69317
  Description of Artificial Sequence: Synthetic oligonucleotide

SEQ ID NO: 416235 - DNA, 32 bp, Artificial Sequence; identical to SEQ ID NO: 69318
  Description of Artificial Sequence: Synthetic oligonucleotide

SEQ ID NO: 416236 - DNA, 31 bp, Artificial Sequence; identical to SEQ ID NO: 69319
  Description of Artificial Sequence: Synthetic oligonucleotide

SEQ ID NO: 416237 - DNA, 31 bp, Artificial Sequence; identical to SEQ ID NO: 69320
  Description of Artificial Sequence: Synthetic oligonucleotide

SEQ ID NO: 416238 - DNA, 30 bp, Artificial Sequence; identical to SEQ ID NO: 69321
  Description of Artificial Sequence: Synthetic oligonucleotide

SEQ ID NO: 416239 - DNA, 29 bp, Artificial Sequence
  Description of Artificial Sequence: Synthetic oligonucleotide
ccataaccaagaggagtacgtgcgcttcg

SEQ ID NO: 416240 - DNA, 30 bp, Artificial Sequence; identical to SEQ ID NO: 69323
  Description of Artificial Sequence: Synthetic oligonucleotide

SEQ ID NO: 416241 - DNA, 30 bp, Artificial Sequence; identical to SEQ ID NO: 69324
  Description of Artificial Sequence: Synthetic oligonucleotide

SEQ ID NO: 416242 - DNA, 29 bp, Artificial Sequence
  Description of Artificial Sequence: Synthetic oligonucleotide
gcagacacaactacggggttggtgagaac

SEQ ID NO: 416243 - DNA, 31 bp, Artificial Sequence; identical to SEQ ID NO: 69326
  Description of Artificial Sequence: Synthetic oligonucleotide

SEQ ID NO: 416244 - DNA, 32 bp, Artificial Sequence; identical to SEQ ID NO: 69327
  Description of Artificial Sequence: Synthetic oligonucleotide

SEQ ID NO: 416245 - DNA, 31 bp, Artificial Sequence; identical to SEQ ID NO: 69328
  Description of Artificial Sequence: Synthetic oligonucleotide

SEQ ID NO: 416246 - DNA, 31 bp, Artificial Sequence; identical to SEQ ID NO: 69329
  Description of Artificial Sequence: Synthetic oligonucleotide

SEQ ID NO: 416247 - DNA, 30 bp, Artificial Sequence; identical to SEQ ID NO: 69330
  Description of Artificial Sequence: Synthetic oligonucleotide

SEQ ID NO: 416248 - DNA, 30 bp, Artificial Sequence; identical to SEQ ID NO: 69331
  Description of Artificial Sequence: Synthetic oligonucleotide

SEQ ID NO: 416249 - DNA, 29 bp, Artificial Sequence
  Description of Artificial Sequence: Synthetic oligonucleotide
caactacggggttggtgagaacttcacgg

SEQ ID NO: 416250 - DNA, 30 bp, Artificial Sequence; identical to SEQ ID NO: 69333
  Description of Artificial Sequence: Synthetic oligonucleotide

SEQ ID NO: 416251 - DNA, 29 bp, Artificial Sequence
  Description of Artificial Sequence: Synthetic oligonucleotide
actacggggttggtgagaacttcacggtg

SEQ ID NO: 416252 - DNA, 28 bp, Artificial Sequence
  Description of Artificial Sequence: Synthetic oligonucleotide
ctacggggttggtgagaacttcacggtg

SEQ ID NO: 416253 - DNA, 28 bp, Artificial Sequence
  Description of Artificial Sequence: Synthetic oligonucleotide
tacggggttggtgagaacttcacggtgc

SEQ ID NO: 416254 - DNA, 27 bp, Artificial Sequence
  Description of Artificial Sequence: Synthetic oligonucleotide
acggggttggtgagaacttcacggtgc

SEQ ID NO: 416255 - DNA, 27 bp, Artificial Sequence
  Description of Artificial Sequence: Synthetic oligonucleotide
cggggttggtgagaacttcacggtgca

SEQ ID NO: 416256 - DNA, 27 bp, Artificial Sequence
  Description of Artificial Sequence: Synthetic oligonucleotide
ggggttggtgagaacttcacggtgcag

SEQ ID NO: 416257 - DNA, 27 bp, Artificial Sequence
  Description of Artificial Sequence: Synthetic oligonucleotide
gggttggtgagaacttcacggtgcagc

SEQ ID NO: 416258 - DNA, 27 bp, Artificial Sequence
  Description of Artificial Sequence: Synthetic oligonucleotide
ggttggtgagaacttcacggtgcagcg

SEQ ID NO: 416259 - DNA, 27 bp, Artificial Sequence
  Description of Artificial Sequence: Synthetic oligonucleotide
gttggtgagaacttcacggtgcagcgg

SEQ ID NO: 416260 - DNA, 27 bp, Artificial Sequence
  Description of Artificial Sequence: Synthetic oligonucleotide
ttggtgagaacttcacggtgcagcggc

SEQ ID NO: 416261 - DNA, 26 bp, Artificial Sequence
  Description of Artificial Sequence: Synthetic oligonucleotide
tggtgagaacttcacggtgcagcggc

SEQ ID NO: 416262 - DNA, 25 bp, Artificial Sequence
  Description of Artificial Sequence: Synthetic oligonucleotide
ggtgagaacttcacggtgcagcggc

SEQ ID NO: 416263 - DNA, 26 bp, Artificial Sequence
  Description of Artificial Sequence: Synthetic oligonucleotide
gtgagaacttcacggtgcagcggcga

SEQ ID NO: 416264 - DNA, 26 bp, Artificial Sequence
  Description of Artificial Sequence: Synthetic oligonucleotide
tgagaacttcacggtgcagcggcgag

SEQ ID NO: 416265 - DNA, 31 bp, Artificial Sequence; identical to SEQ ID NO: 69348
  Description of Artificial Sequence: Synthetic oligonucleotide

SEQ ID NO: 416266 - DNA, 31 bp, Artificial Sequence; identical to SEQ ID NO: 69349
  Description of Artificial Sequence: Synthetic oligonucleotide

SEQ ID NO: 416267 - DNA, 30 bp, Artificial Sequence; identical to SEQ ID NO: 69350
  Description of Artificial Sequence: Synthetic oligonucleotide

SEQ ID NO: 416268 - DNA, 29 bp, Artificial Sequence
  Description of Artificial Sequence: Synthetic oligonucleotide
cagccagaaggacatcctggaagacaagc

SEQ ID NO: 416269 - DNA, 29 bp, Artificial Sequence
  Description of Artificial Sequence: Synthetic oligonucleotide
agccagaaggacatcctggaagacaagcg

SEQ ID NO: 416270 - DNA, 28 bp, Artificial Sequence
  Description of Artificial Sequence: Synthetic oligonucleotide
gccagaaggacatcctggaagacaagcg

SEQ ID NO: 416271 - DNA, 28 bp, Artificial Sequence
  Description of Artificial Sequence: Synthetic oligonucleotide
ccagaaggacatcctggaagacaagcgg

SEQ ID NO: 416272 - DNA, 28 bp, Artificial Sequence
  Description of Artificial Sequence: Synthetic oligonucleotide
cagaaggacatcctggaagacaagcggg

SEQ ID NO: 416273 - DNA, 28 bp, Artificial Sequence
  Description of Artificial Sequence: Synthetic oligonucleotide
agaaggacatcctggaagacaagcgggc

SEQ ID NO: 416274 - DNA, 27 bp, Artificial Sequence
  Description of Artificial Sequence: Synthetic oligonucleotide
gaaggacatcctggaagacaagcgggc

SEQ ID NO: 416275 - DNA, 27 bp, Artificial Sequence
  Description of Artificial Sequence: Synthetic oligonucleotide
aaggacatcctggaagacaagcgggcc

SEQ ID NO: 416276 - DNA, 26 bp, Artificial Sequence
  Description of Artificial Sequence: Synthetic oligonucleotide
aggacatcctggaagacaagcgggcc

SEQ ID NO: 416277 - DNA, 25 bp, Artificial Sequence
  Description of Artificial Sequence: Synthetic oligonucleotide
ggacatcctggaagacaagcgggcc

SEQ ID NO: 416278 - DNA, 25 bp, Artificial Sequence
  Description of Artificial Sequence: Synthetic oligonucleotide
gacatcctggaagacaagcgggccg

SEQ ID NO: 416279 - DNA, 25 bp, Artificial Sequence
  Description of Artificial Sequence: Synthetic oligonucleotide
acatcctggaagacaagcgggccgc

SEQ ID NO: 416280 - DNA, 24 bp, Artificial Sequence
  Description of Artificial Sequence: Synthetic oligonucleotide
catcctggaagacaagcgggccgc

SEQ ID NO: 416281 - DNA, 24 bp, Artificial Sequence
  Description of Artificial Sequence: Synthetic oligonucleotide
atcctggaagacaagcgggccgcg

SEQ ID NO: 416282 - DNA, 23 bp, Artificial Sequence
  Description of Artificial Sequence: Synthetic oligonucleotide
tcctggaagacaagcgggccgcg

SEQ ID NO: 416283 - DNA, 22 bp, Artificial Sequence
  Description of Artificial Sequence: Synthetic oligonucleotide
cctggaagacaagcgggccgcg

SEQ ID NO: 416284 - DNA, 23 bp, Artificial Sequence
  Description of Artificial Sequence: Synthetic oligonucleotide
ctggaagacaagcgggccgcggt

SEQ ID NO: 416285 - DNA, 23 bp, Artificial Sequence
  Description of Artificial Sequence: Synthetic oligonucleotide
tggaagacaagcgggccgcggtg

SEQ ID NO: 416286 - DNA, 22 bp, Artificial Sequence
  Description of Artificial Sequence: Synthetic oligonucleotide
ggaagacaagcgggccgcggtg

SEQ ID NO: 416287 - DNA, 23 bp, Artificial Sequence
  Description of Artificial Sequence: Synthetic oligonucleotide
gaagacaagcgggccgcggtgga

SEQ ID NO: 416288 - DNA, 24 bp, Artificial Sequence
  Description of Artificial Sequence: Synthetic oligonucleotide
aagacaagcgggccgcggtggaca

SEQ ID NO: 416289 - DNA, 23 bp, Artificial Sequence
  Description of Artificial Sequence: Synthetic oligonucleotide
agacaagcgggccgcggtggaca

SEQ ID NO: 416290 - DNA, 22 bp, Artificial Sequence
  Description of Artificial Sequence: Synthetic oligonucleotide
gacaagcgggccgcggtggaca

SEQ ID NO: 416291 - DNA, 22 bp, Artificial Sequence
  Description of Artificial Sequence: Synthetic oligonucleotide
acaagcgggccgcggtggacac

SEQ ID NO: 416292 - DNA, 21 bp, Artificial Sequence
  Description of Artificial Sequence: Synthetic oligonucleotide
caagcgggccgcggtggacac

SEQ ID NO: 416293 - DNA, 28 bp, Artificial Sequence
  Description of Artificial Sequence: Synthetic oligonucleotide
tctcacagtggaatggagtgcacggtcc

SEQ ID NO: 416294 - DNA, 27 bp, Artificial Sequence
  Description of Artificial Sequence: Synthetic oligonucleotide
ctcacagtggaatggagtgcacggtcc

SEQ ID NO: 416295 - DNA, 27 bp, Artificial Sequence
  Description of Artificial Sequence: Synthetic oligonucleotide
tcacagtggaatggagtgcacggtccg

SEQ ID NO: 416296 - DNA, 27 bp, Artificial Sequence
  Description of Artificial Sequence: Synthetic oligonucleotide
cacagtggaatggagtgcacggtccga

SEQ ID NO: 416297 - DNA, 29 bp, Artificial Sequence
  Description of Artificial Sequence: Synthetic oligonucleotide
acagtggaatggagtgcacggtccgaatc

SEQ ID NO: 416298 - DNA, 28 bp, Artificial Sequence
  Description of Artificial Sequence: Synthetic oligonucleotide
cagtggaatggagtgcacggtccgaatc

SEQ ID NO: 416299 - DNA, 29 bp, Artificial Sequence
  Description of Artificial Sequence: Synthetic oligonucleotide
agtggaatggagtgcacggtccgaatctg

SEQ ID NO: 416300 - DNA, 28 bp, Artificial Sequence
  Description of Artificial Sequence: Synthetic oligonucleotide
gtggaatggagtgcacggtccgaatctg

SEQ ID NO: 416301 - DNA, 28 bp, Artificial Sequence
  Description of Artificial Sequence: Synthetic oligonucleotide
tggaatggagtgcacggtccgaatctgc

SEQ ID NO: 416302 - DNA, 27 bp, Artificial Sequence
  Description of Artificial Sequence: Synthetic oligonucleotide
ggaatggagtgcacggtccgaatctgc

SEQ ID NO: 416303 - DNA, 28 bp, Artificial Sequence
  Description of Artificial Sequence: Synthetic oligonucleotide
gaatggagtgcacggtccgaatctgcac

SEQ ID NO: 416304 - DNA, 29 bp, Artificial Sequence
  Description of Artificial Sequence: Synthetic oligonucleotide
aatggagtgcacggtccgaatctgcacag

SEQ ID NO: 416305 - DNA, 28 bp, Artificial Sequence
  Description of Artificial Sequence: Synthetic oligonucleotide
atggagtgcacggtccgaatctgcacag

SEQ ID NO: 416306 - DNA, 27 bp, Artificial Sequence
  Description of Artificial Sequence: Synthetic oligonucleotide
tggagtgcacggtccgaatctgcacag

SEQ ID NO: 416307 - DNA, 27 bp, Artificial Sequence
  Description of Artificial Sequence: Synthetic oligonucleotide
ggagtgcacggtccgaatctgcacaga

SEQ ID NO: 416308 - DNA, 27 bp, Artificial Sequence
  Description of Artificial Sequence: Synthetic oligonucleotide
gagtgcacggtccgaatctgcacagag

SEQ ID NO: 416309 - DNA, 27 bp, Artificial Sequence
  Description of Artificial Sequence: Synthetic oligonucleotide
agtgcacggtccgaatctgcacagagc

SEQ ID NO: 416310 - DNA, 27 bp, Artificial Sequence
  Description of Artificial Sequence: Synthetic oligonucleotide
gtgcacggtccgaatctgcacagagca

SEQ ID NO: 416311 - DNA, 28 bp, Artificial Sequence
  Description of Artificial Sequence: Synthetic oligonucleotide
tgcacggtccgaatctgcacagagcaag

SEQ ID NO: 416312 - DNA, 27 bp, Artificial Sequence
  Description of Artificial Sequence: Synthetic oligonucleotide
gcacggtccgaatctgcacagagcaag

SEQ ID NO: 416313 - DNA, 29 bp, Artificial Sequence
  Description of Artificial Sequence: Synthetic oligonucleotide
cacggtccgaatctgcacagagcaagatg

SEQ ID NO: 416314 - DNA, 29 bp, Artificial Sequence
  Description of Artificial Sequence: Synthetic oligonucleotide
acggtccgaatctgcacagagcaagatgc

SEQ ID NO: 416315 - DNA, 28 bp, Artificial Sequence
  Description of Artificial Sequence: Synthetic oligonucleotide
cggtccgaatctgcacagagcaagatgc

SEQ ID NO: 416316 - DNA, 29 bp, Artificial Sequence
  Description of Artificial Sequence: Synthetic oligonucleotide
ggtccgaatctgcacagagcaagatgctg

SEQ ID NO: 416317 - DNA, 30 bp, Artificial Sequence
  Description of Artificial Sequence: Synthetic oligonucleotide
gtccgaatctgcacagagcaagatgctgag

SEQ ID NO: 416318 - DNA, 31 bp, Artificial Sequence
  Description of Artificial Sequence: Synthetic oligonucleotide
tccgaatctgcacagagcaagatgctgagtg

SEQ ID NO: 416319 - DNA, 30 bp, Artificial Sequence
  Description of Artificial Sequence: Synthetic oligonucleotide
ccgaatctgcacagagcaagatgctgagtg

SEQ ID NO: 416320 - DNA, 30 bp, Artificial Sequence
  Description of Artificial Sequence: Synthetic oligonucleotide
cgaatctgcacagagcaagatgctgagtgg

SEQ ID NO: 416321 - DNA, 36 bp, Artificial Sequence; identical to SEQ ID NO: 70365
  Description of Artificial Sequence: Synthetic oligonucleotide

SEQ ID NO: 416322 - DNA, 36 bp, Artificial Sequence; identical to SEQ ID NO: 70366
  Description of Artificial Sequence: Synthetic oligonucleotide

SEQ ID NO: 416323 - DNA, 35 bp, Artificial Sequence; identical to SEQ ID NO: 70367
  Description of Artificial Sequence: Synthetic oligonucleotide

SEQ ID NO: 416324 - DNA, 34 bp, Artificial Sequence; identical to SEQ ID NO: 70368
  Description of Artificial Sequence: Synthetic oligonucleotide

SEQ ID NO: 416325 - DNA, 34 bp, Artificial Sequence; identical to SEQ ID NO: 70369
  Description of Artificial Sequence: Synthetic oligonucleotide

SEQ ID NO: 416326 - DNA, 35 bp, Artificial Sequence; identical to SEQ ID NO: 70370
  Description of Artificial Sequence: Synthetic oligonucleotide

SEQ ID NO: 416327 - DNA, 34 bp, Artificial Sequence; identical to SEQ ID NO: 70371
  Description of Artificial Sequence: Synthetic oligonucleotide

SEQ ID NO: 416328 - DNA, 34 bp, Artificial Sequence; identical to SEQ ID NO: 70372
  Description of Artificial Sequence: Synthetic oligonucleotide

SEQ ID NO: 416329 - DNA, 34 bp, Artificial Sequence; identical to SEQ ID NO: 70373
  Description of Artificial Sequence: Synthetic oligonucleotide

SEQ ID NO: 416330 - DNA, 33 bp, Artificial Sequence; identical to SEQ ID NO: 70374
  Description of Artificial Sequence: Synthetic oligonucleotide

SEQ ID NO: 416331 - DNA, 33 bp, Artificial Sequence; identical to SEQ ID NO: 70375
  Description of Artificial Sequence: Synthetic oligonucleotide

SEQ ID NO: 416332 - DNA, 32 bp, Artificial Sequence; identical to SEQ ID NO: 70376
  Description of Artificial Sequence: Synthetic oligonucleotide

SEQ ID NO: 416333 - DNA, 34 bp, Artificial Sequence; identical to SEQ ID NO: 70377
  Description of Artificial Sequence: Synthetic oligonucleotide

SEQ ID NO: 416334 - DNA, 33 bp, Artificial Sequence; identical to SEQ ID NO: 70378
  Description of Artificial Sequence: Synthetic oligonucleotide

SEQ ID NO: 416335 - DNA, 32 bp, Artificial Sequence; identical to SEQ ID NO: 70379
  Description of Artificial Sequence: Synthetic oligonucleotide

SEQ ID NO: 416336 - DNA, 25 bp, Artificial Sequence
  Description of Artificial Sequence: Synthetic oligonucleotide
tggaagacaggcgggccctggtgta

SEQ ID NO: 416337 - DNA, 24 bp, Artificial Sequence
  Description of Artificial Sequence: Synthetic oligonucleotide
ggaagacaggcgggccctggtgta

SEQ ID NO: 416338 - DNA, 25 bp, Artificial Sequence
  Description of Artificial Sequence: Synthetic oligonucleotide
gaagacaggcgggccctggtgtaca

SEQ ID NO: 416339 - DNA, 25 bp, Artificial Sequence
  Description of Artificial Sequence: Synthetic oligonucleotide
aagacaggcgggccctggtgtacac

SEQ ID NO: 416340 - DNA, 24 bp, Artificial Sequence
  Description of Artificial Sequence: Synthetic oligonucleotide
agacaggcgggccctggtgtacac

SEQ ID NO: 416341 - DNA, 23 bp, Artificial Sequence
  Description of Artificial Sequence: Synthetic oligonucleotide
gacaggcgggccctggtgtacac

SEQ ID NO: 416342 - DNA, 25 bp, Artificial Sequence
  Description of Artificial Sequence: Synthetic oligonucleotide
acaggcgggccctggtgtacaccta

SEQ ID NO: 416343 - DNA, 24 bp, Artificial Sequence
  Description of Artificial Sequence: Synthetic oligonucleotide
caggcgggccctggtgtacaccta

SEQ ID NO: 416344 - DNA, 25 bp, Artificial Sequence
  Description of Artificial Sequence: Synthetic oligonucleotide
aggcgggccctggtgtacacctact

SEQ ID NO: 416345 - DNA, 24 bp, Artificial Sequence
  Description of Artificial Sequence: Synthetic oligonucleotide
ggcgggccctggtgtacacctact

SEQ ID NO: 416346 - DNA, 24 bp, Artificial Sequence
  Description of Artificial Sequence: Synthetic oligonucleotide
gcgggccctggtgtacacctactg

SEQ ID NO: 416347 - DNA, 25 bp, Artificial Sequence
  Description of Artificial Sequence: Synthetic oligonucleotide
cgggccctggtgtacacctactgca

SEQ ID NO: 416348 - DNA, 26 bp, Artificial Sequence
  Description of Artificial Sequence: Synthetic oligonucleotide
gggccctggtgtacacctactgcaga

SEQ ID NO: 416349 - DNA, 27 bp, Artificial Sequence
  Description of Artificial Sequence: Synthetic oligonucleotide
ggccctggtgtacacctactgcagaca

SEQ ID NO: 416350 - DNA, 27 bp, Artificial Sequence
  Description of Artificial Sequence: Synthetic oligonucleotide
gccctggtgtacacctactgcagacac

SEQ ID NO: 416351 - DNA, 29 bp, Artificial Sequence
  Description of Artificial Sequence: Synthetic oligonucleotide
ccctggtgtacacctactgcagacacaac

SEQ ID NO: 416352 - DNA, 31 bp, Artificial Sequence
  Description of Artificial Sequence: Synthetic oligonucleotide
cctggtgtacacctactgcagacacaactac

SEQ ID NO: 416353 - DNA, 31 bp, Artificial Sequence
  Description of Artificial Sequence: Synthetic oligonucleotide
ctggtgtacacctactgcagacacaactacg

SEQ ID NO: 416354 - DNA, 31 bp, Artificial Sequence
  Description of Artificial Sequence: Synthetic oligonucleotide
tggtgtacacctactgcagacacaactacgg

SEQ ID NO: 416355 - DNA, 30 bp, Artificial Sequence
  Description of Artificial Sequence: Synthetic oligonucleotide
ggtgtacacctactgcagacacaactacgg

SEQ ID NO: 416356 - DNA, 30 bp, Artificial Sequence
  Description of Artificial Sequence: Synthetic oligonucleotide
gtgtacacctactgcagacacaactacggg

SEQ ID NO: 416357 - DNA, 30 bp, Artificial Sequence
  Description of Artificial Sequence: Synthetic oligonucleotide
tgtacacctactgcagacacaactacgggg

SEQ ID NO: 416358 - DNA, 29 bp, Artificial Sequence
  Description of Artificial Sequence: Synthetic oligonucleotide
gtacacctactgcagacacaactacgggg

SEQ ID NO: 416359 - DNA, 31 bp, Artificial Sequence
  Description of Artificial Sequence: Synthetic oligonucleotide
tacacctactgcagacacaactacggggttg

SEQ ID NO: 416360 - DNA, 31 bp, Artificial Sequence
  Description of Artificial Sequence: Synthetic oligonucleotide
acacctactgcagacacaactacggggttag

SEQ ID NO: 416361 - DNA, 30 bp, Artificial Sequence
  Description of Artificial Sequence: Synthetic oligonucleotide
cacctactgcagacacaactacggggttag

SEQ ID NO: 416362 - DNA, 31 bp, Artificial Sequence
  Description of Artificial Sequence: Synthetic oligonucleotide
acctactgcagacacaactacggggttagtg

SEQ ID NO: 416363 - DNA, 30 bp, Artificial Sequence
  Description of Artificial Sequence: Synthetic oligonucleotide
cctactgcagacacaactacggggttagtg

SEQ ID NO: 416364 - DNA, 31 bp, Artificial Sequence
  Description of Artificial Sequence: Synthetic oligonucleotide
ctactgcagacacaactacggggttagtgag

SEQ ID NO: 416365 - DNA, 32 bp, Artificial Sequence
  Description of Artificial Sequence: Synthetic oligonucleotide
tactgcagacacaactacggggttagtgagag

SEQ ID NO: 416366 - DNA, 31 bp, Artificial Sequence
  Description of Artificial Sequence: Synthetic oligonucleotide
actgcagacacaactacggggttagtgagag

SEQ ID NO: 416367 - DNA, 30 bp, Artificial Sequence
  Description of Artificial Sequence: Synthetic oligonucleotide
ctgcagacacaactacggggttagtgagag

SEQ ID NO: 416368 - DNA, 30 bp, Artificial Sequence
  Description of Artificial Sequence: Synthetic oligonucleotide
tgcagacacaactacggggttagtgagagc

SEQ ID NO: 416369 - DNA, 29 bp, Artificial Sequence
  Description of Artificial Sequence: Synthetic oligonucleotide
gcagacacaactacggggttagtgagagc

SEQ ID NO: 416370 - DNA, 31 bp, Artificial Sequence
  Description of Artificial Sequence: Synthetic oligonucleotide
cagacacaactacggggttagtgagagcttc

SEQ ID NO: 416371 - DNA, 32 bp, Artificial Sequence
  Description of Artificial Sequence: Synthetic oligonucleotide
agacacaactacggggttagtgagagcttcac

SEQ ID NO: 416372 - DNA, 31 bp, Artificial Sequence
  Description of Artificial Sequence: Synthetic oligonucleotide
gacacaactacggggttagtgagagcttcac

SEQ ID NO: 416373 - DNA, 32 bp, Artificial Sequence
  Description of Artificial Sequence: Synthetic oligonucleotide
acacaactacggggttagtgagagcttcacag

SEQ ID NO: 416374 - DNA, 31 bp, Artificial Sequence
  Description of Artificial Sequence: Synthetic oligonucleotide
cacaactacggggttagtgagagcttcacag

SEQ ID NO: 416375 - DNA, 32 bp, Artificial Sequence
  Description of Artificial Sequence: Synthetic oligonucleotide
acaactacggggttagtgagagcttcacagtg

SEQ ID NO: 416376 - DNA, 31 bp, Artificial Sequence
  Description of Artificial Sequence: Synthetic oligonucleotide
caactacggggttagtgagagcttcacagtg

SEQ ID NO: 416377 - DNA, 31 bp, Artificial Sequence
  Description of Artificial Sequence: Synthetic oligonucleotide
aactacggggttagtgagagcttcacagtgc

SEQ ID NO: 416378 - DNA, 30 bp, Artificial Sequence
  Description of Artificial Sequence: Synthetic oligonucleotide
actacggggttagtgagagcttcacagtgc

SEQ ID NO: 416379 - DNA, 29 bp, Artificial Sequence
  Description of Artificial Sequence: Synthetic oligonucleotide
ctacggggttagtgagagcttcacagtgc

SEQ ID NO: 416380 - DNA, 30 bp, Artificial Sequence
  Description of Artificial Sequence: Synthetic oligonucleotide
tacggggttagtgagagcttcacagtgcag

SEQ ID NO: 416381 - DNA, 29 bp, Artificial Sequence
  Description of Artificial Sequence: Synthetic oligonucleotide
acggggttagtgagagcttcacagtgcag

SEQ ID NO: 416382 - DNA, 28 bp, Artificial Sequence
  Description of Artificial Sequence: Synthetic oligonucleotide
cggggttagtgagagcttcacagtgcag

SEQ ID NO: 416383 - DNA, 28 bp, Artificial Sequence
  Description of Artificial Sequence: Synthetic oligonucleotide
ggggttagtgagagcttcacagtgcagc

SEQ ID NO: 416384 - DNA, 28 bp, Artificial Sequence
  Description of Artificial Sequence: Synthetic oligonucleotide
gggttagtgagagcttcacagtgcagcg

SEQ ID NO: 416385 - DNA, 28 bp, Artificial Sequence
  Description of Artificial Sequence: Synthetic oligonucleotide
ggttagtgagagcttcacagtgcagcgg

SEQ ID NO: 416386 - DNA, 28 bp, Artificial Sequence
  Description of Artificial Sequence: Synthetic oligonucleotide
gttagtgagagcttcacagtgcagcggc

SEQ ID NO: 416387 - DNA, 28 bp, Artificial Sequence
  Description of Artificial Sequence: Synthetic oligonucleotide
ttagtgagagcttcacagtgcagcggcg

SEQ ID NO: 416388 - DNA, 27 bp, Artificial Sequence
  Description of Artificial Sequence: Synthetic oligonucleotide
tagtgagagcttcacagtgcagcggcg

SEQ ID NO: 416389 - DNA, 27 bp, Artificial Sequence
  Description of Artificial Sequence: Synthetic oligonucleotide
agtgagagcttcacagtgcagcggcga

SEQ ID NO: 416390 - DNA, 21 bp, Artificial Sequence
  Description of Artificial Sequence: Synthetic oligonucleotide
tggggcggcctagcgccgagt

SEQ ID NO: 416391 - DNA, 20 bp, Artificial Sequence
  Description of Artificial Sequence: Synthetic oligonucleotide
ggggcggcctagcgccgagt

SEQ ID NO: 416392 - DNA, 20 bp, Artificial Sequence
  Description of Artificial Sequence: Synthetic oligonucleotide
gggcggcctagcgccgagtc

SEQ ID NO: 416393 - DNA, 21 bp, Artificial Sequence
  Description of Artificial Sequence: Synthetic oligonucleotide
ggcggcctagcgccgagtcct

SEQ ID NO: 416394 - DNA, 21 bp, Artificial Sequence
  Description of Artificial Sequence: Synthetic oligonucleotide
gcggcctagcgccgagtcctg

SEQ ID NO: 416395 - DNA, 23 bp, Artificial Sequence
  Description of Artificial Sequence: Synthetic oligonucleotide
cggcctagcgccgagtcctggaa

SEQ ID NO: 416396 - DNA, 24 bp, Artificial Sequence
  Description of Artificial Sequence: Synthetic oligonucleotide
ggcctagcgccgagtcctggaaca

SEQ ID NO: 416397 - DNA, 24 bp, Artificial Sequence
  Description of Artificial Sequence: Synthetic oligonucleotide
gcctagcgccgagtcctggaacag

SEQ ID NO: 416398 - DNA, 24 bp, Artificial Sequence
  Description of Artificial Sequence: Synthetic oligonucleotide
cctagcgccgagtcctggaacagc

SEQ ID NO: 416399 - DNA, 25 bp, Artificial Sequence
  Description of Artificial Sequence: Synthetic oligonucleotide
ctagcgccgagtcctggaacagcca

SEQ ID NO: 416400 - DNA, 27 bp, Artificial Sequence
  Description of Artificial Sequence: Synthetic oligonucleotide
tagcgccgagtcctggaacagccagaa

SEQ ID NO: 416401 - DNA, 26 bp, Artificial Sequence
  Description of Artificial Sequence: Synthetic oligonucleotide
agcgccgagtcctggaacagccagaa

SEQ ID NO: 416402 - DNA, 25 bp, Artificial Sequence
  Description of Artificial Sequence: Synthetic oligonucleotide
gcgccgagtcctggaacagccagaa

SEQ ID NO: 416403 - DNA, 27 bp, Artificial Sequence
  Description of Artificial Sequence: Synthetic oligonucleotide
tggctggggacacccaaccacgtttct

SEQ ID NO: 416404 - DNA, 27 bp, Artificial Sequence
  Description of Artificial Sequence: Synthetic oligonucleotide
ggctggggacacccaaccacgtttctt

SEQ ID NO: 416405 - DNA, 27 bp, Artificial Sequence
  Description of Artificial Sequence: Synthetic oligonucleotide
gctggggacacccaaccacgtttcttg

SEQ ID NO: 416406 - DNA, 29 bp, Artificial Sequence
  Description of Artificial Sequence: Synthetic oligonucleotide
ctggggacacccaaccacgtttcttgaag

SEQ ID NO: 416407 - DNA, 29 bp, Artificial Sequence
  Description of Artificial Sequence: Synthetic oligonucleotide
tggggacacccaaccacgtttcttgaagc

SEQ ID NO: 416408 - DNA, 28 bp, Artificial Sequence
  Description of Artificial Sequence: Synthetic oligonucleotide
ggggacacccaaccacgtttcttgaagc

SEQ ID NO: 416409 - DNA, 29 bp, Artificial Sequence
  Description of Artificial Sequence: Synthetic oligonucleotide
gggacacccaaccacgtttcttgaagcag

SEQ ID NO: 416410 - DNA, 29 bp, Artificial Sequence
  Description of Artificial Sequence: Synthetic oligonucleotide
ggacacccaaccacgtttcttgaagcagg

SEQ ID NO: 416411 - DNA, 33 bp, Artificial Sequence; identical to SEQ ID NO: 69384
  Description of Artificial Sequence: Synthetic oligonucleotide

SEQ ID NO: 416412 - DNA, 36 bp, Artificial Sequence; identical to SEQ ID NO: 69385
  Description of Artificial Sequence: Synthetic oligonucleotide

SEQ ID NO: 416413 - DNA, 35 bp, Artificial Sequence; identical to SEQ ID NO: 69386
  Description of Artificial Sequence: Synthetic oligonucleotide

SEQ ID NO: 416414 - DNA, 36 bp, Artificial Sequence; identical to SEQ ID NO: 69387
  Description of Artificial Sequence: Synthetic oligonucleotide

SEQ ID NO: 416415 - DNA, 35 bp, Artificial Sequence; identical to SEQ ID NO: 69388
  Description of Artificial Sequence: Synthetic oligonucleotide

SEQ ID NO: 416416 - DNA, 36 bp, Artificial Sequence; identical to SEQ ID NO: 69389
  Description of Artificial Sequence: Synthetic oligonucleotide

SEQ ID NO: 416417 - DNA, 37 bp, Artificial Sequence; identical to SEQ ID NO: 69390
  Description of Artificial Sequence: Synthetic oligonucleotide

SEQ ID NO: 416418 - DNA, 41 bp, Artificial Sequence; identical to SEQ ID NO: 69391
  Description of Artificial Sequence: Synthetic oligonucleotide

SEQ ID NO: 416419 - DNA, 40 bp, Artificial Sequence; identical to SEQ ID NO: 69392
  Description of Artificial Sequence: Synthetic oligonucleotide

SEQ ID NO: 416420 - DNA, 39 bp, Artificial Sequence; identical to SEQ ID NO: 69393
  Description of Artificial Sequence: Synthetic oligonucleotide

SEQ ID NO: 416421 - DNA, 41 bp, Artificial Sequence; identical to SEQ ID NO: 69394
  Description of Artificial Sequence: Synthetic oligonucleotide

SEQ ID NO: 416422 - DNA, 43 bp, Artificial Sequence; identical to SEQ ID NO: 69395
  Description of Artificial Sequence: Synthetic oligonucleotide

SEQ ID NO: 416423 - DNA, 42 bp, Artificial Sequence; identical to SEQ ID NO: 69396
  Description of Artificial Sequence: Synthetic oligonucleotide

SEQ ID NO: 416424 - DNA, 42 bp, Artificial Sequence; identical to SEQ ID NO: 69397
  Description of Artificial Sequence: Synthetic oligonucleotide

SEQ ID NO: 416425 - DNA, 42 bp, Artificial Sequence; identical to SEQ ID NO: 69398
  Description of Artificial Sequence: Synthetic oligonucleotide

SEQ ID NO: 416426 - DNA, 41 bp, Artificial Sequence; identical to SEQ ID NO: 69399
  Description of Artificial Sequence: Synthetic oligonucleotide

SEQ ID NO: 416427 - DNA, 40 bp, Artificial Sequence; identical to SEQ ID NO: 69400
  Description of Artificial Sequence: Synthetic oligonucleotide

SEQ ID NO: 416428 - DNA, 39 bp, Artificial Sequence; identical to SEQ ID NO: 69401
  Description of Artificial Sequence: Synthetic oligonucleotide

SEQ ID NO: 416429 - DNA, 39 bp, Artificial Sequence; identical to SEQ ID NO: 69402
  Description of Artificial Sequence: Synthetic oligonucleotide

SEQ ID NO: 416430 - DNA, 38 bp, Artificial Sequence; identical to SEQ ID NO: 69403
  Description of Artificial Sequence: Synthetic oligonucleotide

SEQ ID NO: 416431 - DNA, 37 bp, Artificial Sequence; identical to SEQ ID NO: 69404
  Description of Artificial Sequence: Synthetic oligonucleotide

SEQ ID NO: 416432 - DNA, 38 bp, Artificial Sequence; identical to SEQ ID NO: 69405
  Description of Artificial Sequence: Synthetic oligonucleotide

SEQ ID NO: 416433 - DNA, 37 bp, Artificial Sequence; identical to SEQ ID NO: 69406
  Description of Artificial Sequence: Synthetic oligonucleotide

SEQ ID NO: 416434 - DNA, 36 bp, Artificial Sequence; identical to SEQ ID NO: 69407
  Description of Artificial Sequence: Synthetic oligonucleotide

SEQ ID NO: 416435 - DNA, 36 bp, Artificial Sequence; identical to SEQ ID NO: 69408
  Description of Artificial Sequence: Synthetic oligonucleotide

SEQ ID NO: 416436 - DNA, 36 bp, Artificial Sequence; identical to SEQ ID NO: 69409
  Description of Artificial Sequence: Synthetic oligonucleotide

SEQ ID NO: 416437 - DNA, 35 bp, Artificial Sequence; identical to SEQ ID NO: 69410
  Description of Artificial Sequence: Synthetic oligonucleotide

SEQ ID NO: 416438 - DNA, 36 bp, Artificial Sequence; identical to SEQ ID NO: 69411
  Description of Artificial Sequence: Synthetic oligonucleotide

SEQ ID NO: 416439 - DNA, 36 bp, Artificial Sequence; identical to SEQ ID NO: 69412
  Description of Artificial Sequence: Synthetic oligonucleotide

SEQ ID NO: 416440 - DNA, 35 bp, Artificial Sequence; identical to SEQ ID NO: 69413
  Description of Artificial Sequence: Synthetic oligonucleotide

SEQ ID NO: 416441 - DNA, 34 bp, Artificial Sequence; identical to SEQ ID NO: 69414
  Description of Artificial Sequence: Synthetic oligonucleotide

SEQ ID NO: 416442 - DNA, 33 bp, Artificial Sequence; identical to SEQ ID NO: 69415
  Description of Artificial Sequence: Synthetic oligonucleotide

SEQ ID NO: 416443 - DNA, 32 bp, Artificial Sequence; identical to SEQ ID NO: 69416
  Description of Artificial Sequence: Synthetic oligonucleotide

SEQ ID NO: 416444 - DNA, 32 bp, Artificial Sequence; identical to SEQ ID NO: 69417
  Description of Artificial Sequence: Synthetic oligonucleotide

SEQ ID NO: 416445 - DNA, 31 bp, Artificial Sequence; identical to SEQ ID NO: 69418
  Description of Artificial Sequence: Synthetic oligonucleotide

SEQ ID NO: 416446 - DNA, 24 bp, Artificial Sequence
  Description of Artificial Sequence: Synthetic oligonucleotide
aacgggacggagcgggtgcggtat

SEQ ID NO: 416447 - DNA, 23 bp, Artificial Sequence
  Description of Artificial Sequence: Synthetic oligonucleotide
acgggacggagcgggtgcggtat

SEQ ID NO: 416448 - DNA, 22 bp, Artificial Sequence
  Description of Artificial Sequence: Synthetic oligonucleotide
cgggacggagcgggtgcggtat

SEQ ID NO: 416449 - DNA, 23 bp, Artificial Sequence
  Description of Artificial Sequence: Synthetic oligonucleotide
gggacggagcgggtgcggtatct

SEQ ID NO: 416450 - DNA, 23 bp, Artificial Sequence
  Description of Artificial Sequence: Synthetic oligonucleotide
ggacggagcgggtgcggtatctg

SEQ ID NO: 416451 - DNA, 24 bp, Artificial Sequence
  Description of Artificial Sequence: Synthetic oligonucleotide
gacggagcgggtgcggtatctgca

SEQ ID NO: 416452 - DNA, 25 bp, Artificial Sequence
  Description of Artificial Sequence: Synthetic oligonucleotide
acggagcgggtgcggtatctgcaca

SEQ ID NO: 416453 - DNA, 24 bp, Artificial Sequence
  Description of Artificial Sequence: Synthetic oligonucleotide
cggagcgggtgcggtatctgcaca

SEQ ID NO: 416454 - DNA, 25 bp, Artificial Sequence
  Description of Artificial Sequence: Synthetic oligonucleotide
ggagcgggtgcggtatctgcacaga

SEQ ID NO: 416455 - DNA, 25 bp, Artificial Sequence
  Description of Artificial Sequence: Synthetic oligonucleotide
gagcgggtgcggtatctgcacagag

SEQ ID NO: 416456 - DNA, 25 bp, Artificial Sequence
  Description of Artificial Sequence: Synthetic oligonucleotide
agcgggtgcggtatctgcacagagg

SEQ ID NO: 416457 - DNA, 24 bp, Artificial Sequence
  Description of Artificial Sequence: Synthetic oligonucleotide
gcgggtgcggtatctgcacagagg

SEQ ID NO: 416458 - DNA, 26 bp, Artificial Sequence
  Description of Artificial Sequence: Synthetic oligonucleotide
cgggtgcggtatctgcacagaggcat

SEQ ID NO: 416459 - DNA, 27 bp, Artificial Sequence
  Description of Artificial Sequence: Synthetic oligonucleotide
gggtgcggtatctgcacagaggcatct

SEQ ID NO: 416460 - DNA, 31 bp, Artificial Sequence; identical to SEQ ID NO: 69433
  Description of Artificial Sequence: Synthetic oligonucleotide

SEQ ID NO: 416461 - DNA, 31 bp, Artificial Sequence; identical to SEQ ID NO: 69434
  Description of Artificial Sequence: Synthetic oligonucleotide

SEQ ID NO: 416462 - DNA, 33 bp, Artificial Sequence; identical to SEQ ID NO: 69435
  Description of Artificial Sequence: Synthetic oligonucleotide

SEQ ID NO: 416463 - DNA, 32 bp, Artificial Sequence; identical to SEQ ID NO: 69436
  Description of Artificial Sequence: Synthetic oligonucleotide

SEQ ID NO: 416464 - DNA, 33 bp, Artificial Sequence; identical to SEQ ID NO: 69437
  Description of Artificial Sequence: Synthetic oligonucleotide

SEQ ID NO: 416465 - DNA, 33 bp, Artificial Sequence; identical to SEQ ID NO: 69438
  Description of Artificial Sequence: Synthetic oligonucleotide

SEQ ID NO: 416466 - DNA, 34 bp, Artificial Sequence; identical to SEQ ID NO: 69439
  Description of Artificial Sequence: Synthetic oligonucleotide

SEQ ID NO: 416467 - DNA, 36 bp, Artificial Sequence; identical to SEQ ID NO: 69440
  Description of Artificial Sequence: Synthetic oligonucleotide

SEQ ID NO: 416468 - DNA, 35 bp, Artificial Sequence; identical to SEQ ID NO: 69441
  Description of Artificial Sequence: Synthetic oligonucleotide

SEQ ID NO: 416469 - DNA, 34 bp, Artificial Sequence; identical to SEQ ID NO: 69442
  Description of Artificial Sequence: Synthetic oligonucleotide

SEQ ID NO: 416470 - DNA, 33 bp, Artificial Sequence; identical to SEQ ID NO: 69443
  Description of Artificial Sequence: Synthetic oligonucleotide

SEQ ID NO: 416471 - DNA, 33 bp, Artificial Sequence; identical to SEQ ID NO: 69444
  Description of Artificial Sequence: Synthetic oligonucleotide

SEQ ID NO: 416472 - DNA, 32 bp, Artificial Sequence; identical to SEQ ID NO: 69445
  Description of Artificial Sequence: Synthetic oligonucleotide

SEQ ID NO: 416473 - DNA, 33 bp, Artificial Sequence; identical to SEQ ID NO: 69446
  Description of Artificial Sequence: Synthetic oligonucleotide

SEQ ID NO: 416474 - DNA, 33 bp, Artificial Sequence; identical to SEQ ID NO: 69447
  Description of Artificial Sequence: Synthetic oligonucleotide

SEQ ID NO: 416475 - DNA, 32 bp, Artificial Sequence; identical to SEQ ID NO: 69448
  Description of Artificial Sequence: Synthetic oligonucleotide

SEQ ID NO: 416476 - DNA, 32 bp, Artificial Sequence; identical to SEQ ID NO: 69449
  Description of Artificial Sequence: Synthetic oligonucleotide

SEQ ID NO: 416477 - DNA, 31 bp, Artificial Sequence; identical to SEQ ID NO: 69450
  Description of Artificial Sequence: Synthetic oligonucleotide

SEQ ID NO: 416478 - DNA, 31 bp, Artificial Sequence; identical to SEQ ID NO: 69451
  Description of Artificial Sequence: Synthetic oligonucleotide

SEQ ID NO: 416479 - DNA, 30 bp, Artificial Sequence; identical to SEQ ID NO: 69452
  Description of Artificial Sequence: Synthetic oligonucleotide

SEQ ID NO: 416480 - DNA, 32 bp, Artificial Sequence; identical to SEQ ID NO: 69453
  Description of Artificial Sequence: Synthetic oligonucleotide

SEQ ID NO: 416481 - DNA, 32 bp, Artificial Sequence; identical to SEQ ID NO: 69454
  Description of Artificial Sequence: Synthetic oligonucleotide

SEQ ID NO: 416482 - DNA, 33 bp, Artificial Sequence; identical to SEQ ID NO: 69455
  Description of Artificial Sequence: Synthetic oligonucleotide

SEQ ID NO: 416483 - DNA, 27 bp, Artificial Sequence
  Description of Artificial Sequence: Synthetic oligonucleotide
ccgagtcctggaacagccagaaggact

SEQ ID NO: 416484 - DNA, 28 bp, Artificial Sequence
  Description of Artificial Sequence: Synthetic oligonucleotide
cgagtcctggaacagccagaaggacttc

SEQ ID NO: 416485 - DNA, 28 bp, Artificial Sequence
  Description of Artificial Sequence: Synthetic oligonucleotide
gagtcctggaacagccagaaggacttcc

SEQ ID NO: 416486 - DNA, 29 bp, Artificial Sequence
  Description of Artificial Sequence: Synthetic oligonucleotide
agtcctggaacagccagaaggacttcctg

SEQ ID NO: 416487 - DNA, 28 bp, Artificial Sequence
  Description of Artificial Sequence: Synthetic oligonucleotide
gtcctggaacagccagaaggacttcctg

SEQ ID NO: 416488 - DNA, 28 bp, Artificial Sequence
  Description of Artificial Sequence: Synthetic oligonucleotide
tcctggaacagccagaaggacttcctgg

SEQ ID NO: 416489 - DNA, 27 bp, Artificial Sequence
  Description of Artificial Sequence: Synthetic oligonucleotide
cctggaacagccagaaggacttcctgg

SEQ ID NO: 416490 - DNA, 27 bp, Artificial Sequence
  Description of Artificial Sequence: Synthetic oligonucleotide
gaacagccagaaggacttcctggagcg

SEQ ID NO: 416491 - DNA, 27 bp, Artificial Sequence
  Description of Artificial Sequence: Synthetic oligonucleotide
aacagccagaaggacttcctggagcgg

SEQ ID NO: 416492 - DNA, 27 bp, Artificial Sequence
  Description of Artificial Sequence: Synthetic oligonucleotide
acagccagaaggacttcctggagcgga

SEQ ID NO: 416493 - DNA, 26 bp, Artificial Sequence
  Description of Artificial Sequence: Synthetic oligonucleotide
cagccagaaggacttcctggagcgga

SEQ ID NO: 416494 - DNA, 26 bp, Artificial Sequence
  Description of Artificial Sequence: Synthetic oligonucleotide
agccagaaggacttcctggagcggag

SEQ ID NO: 416495 - DNA, 25 bp, Artificial Sequence
  Description of Artificial Sequence: Synthetic oligonucleotide
gccagaaggacttcctggagcggag

SEQ ID NO: 416496 - DNA, 25 bp, Artificial Sequence
  Description of Artificial Sequence: Synthetic oligonucleotide
ccagaaggacttcctggagcggagg

SEQ ID NO: 416497 - DNA, 25 bp, Artificial Sequence
  Description of Artificial Sequence: Synthetic oligonucleotide
cagaaggacttcctggagcggaggc

SEQ ID NO: 416498 - DNA, 25 bp, Artificial Sequence
  Description of Artificial Sequence: Synthetic oligonucleotide
agaaggacttcctggagcggaggcg

SEQ ID NO: 416499 - DNA, 24 bp, Artificial Sequence
  Description of Artificial Sequence: Synthetic oligonucleotide
gaaggacttcctggagcggaggcg

SEQ ID NO: 416500 - DNA, 24 bp, Artificial Sequence
  Description of Artificial Sequence: Synthetic oligonucleotide
aaggacttcctggagcggaggcgg

SEQ ID NO: 416501 - DNA, 23 bp, Artificial Sequence
  Description of Artificial Sequence: Synthetic oligonucleotide
aggacttcctggagcggaggcgg

SEQ ID NO: 416502 - DNA, 22 bp, Artificial Sequence
  Description of Artificial Sequence: Synthetic oligonucleotide
ggacttcctggagcggaggcgg

SEQ ID NO: 416503 - DNA, 22 bp, Artificial Sequence
  Description of Artificial Sequence: Synthetic oligonucleotide
gacttcctggagcggaggcggg

SEQ ID NO: 416504 - DNA, 22 bp, Artificial Sequence
  Description of Artificial Sequence: Synthetic oligonucleotide
acttcctggagcggaggcgggc

SEQ ID NO: 416505 - DNA, 21 bp, Artificial Sequence
  Description of Artificial Sequence: Synthetic oligonucleotide
cttcctggagcggaggcgggc

SEQ ID NO: 416506 - DNA, 21 bp, Artificial Sequence
  Description of Artificial Sequence: Synthetic oligonucleotide
ttcctggagcggaggcgggcc

SEQ ID NO: 416507 - DNA, 21 bp, Artificial Sequence
  Description of Artificial Sequence: Synthetic oligonucleotide
gcgggccgaggtggacaccgt

SEQ ID NO: 416508 - DNA, 22 bp, Artificial Sequence
  Description of Artificial Sequence: Synthetic oligonucleotide
cgggccgaggtggacaccgtgt

SEQ ID NO: 416509 - DNA, 22 bp, Artificial Sequence
  Description of Artificial Sequence: Synthetic oligonucleotide
gggccgaggtggacaccgtgtg

SEQ ID NO: 416510 - DNA, 23 bp, Artificial Sequence
  Description of Artificial Sequence: Synthetic oligonucleotide
ggccgaggtggacaccgtgtgca

SEQ ID NO: 416511 - DNA, 24 bp, Artificial Sequence
  Description of Artificial Sequence: Synthetic oligonucleotide
gccgaggtggacaccgtgtgcaga

SEQ ID NO: 416512 - DNA, 25 bp, Artificial Sequence
  Description of Artificial Sequence: Synthetic oligonucleotide
ccgaggtggacaccgtgtgcagaca

SEQ ID NO: 416513 - DNA, 27 bp, Artificial Sequence
  Description of Artificial Sequence: Synthetic oligonucleotide
cgaggtggacaccgtgtgcagacacaa

SEQ ID NO: 416514 - DNA, 27 bp, Artificial Sequence
  Description of Artificial Sequence: Synthetic oligonucleotide
gaggtggacaccgtgtgcagacacaac

SEQ ID NO: 416515 - DNA, 28 bp, Artificial Sequence
  Description of Artificial Sequence: Synthetic oligonucleotide
gggttggtgagagcttcacagtgcagag

SEQ ID NO: 416516 - DNA, 28 bp, Artificial Sequence
  Description of Artificial Sequence: Synthetic oligonucleotide
ggttggtgagagcttcacagtgcagagg

SEQ ID NO: 416517 - DNA, 28 bp, Artificial Sequence
  Description of Artificial Sequence: Synthetic oligonucleotide
gttggtgagagcttcacagtgcagaggc

SEQ ID NO: 416518 - DNA, 28 bp, Artificial Sequence
  Description of Artificial Sequence: Synthetic oligonucleotide
ttggtgagagcttcacagtgcagaggcg

SEQ ID NO: 416519 - DNA, 27 bp, Artificial Sequence
  Description of Artificial Sequence: Synthetic oligonucleotide
tggtgagagcttcacagtgcagaggcg

SEQ ID NO: 416520 - DNA, 27 bp, Artificial Sequence
  Description of Artificial Sequence: Synthetic oligonucleotide
ggtgagagcttcacagtgcagaggcga

SEQ ID NO: 416521 - DNA, 27 bp, Artificial Sequence
  Description of Artificial Sequence: Synthetic oligonucleotide
gtgagagcttcacagtgcagaggcgag

SEQ ID NO: 416522 - DNA, 28 bp, Artificial Sequence
  Description of Artificial Sequence: Synthetic oligonucleotide
tgagagcttcacagtgcagaggcgagtc

SEQ ID NO: 416523 - DNA, 27 bp, Artificial Sequence
  Description of Artificial Sequence: Synthetic oligonucleotide
gagagcttcacagtgcagaggcgagtc

SEQ ID NO: 416524 - DNA, 27 bp, Artificial Sequence
  Description of Artificial Sequence: Synthetic oligonucleotide
agagcttcacagtgcagaggcgagtcc

SEQ ID NO: 416525 - DNA, 27 bp, Artificial Sequence
  Description of Artificial Sequence: Synthetic oligonucleotide
gagcttcacagtgcagaggcgagtcca

SEQ ID NO: 416526 - DNA, 28 bp, Artificial Sequence
  Description of Artificial Sequence: Synthetic oligonucleotide
agcttcacagtgcagaggcgagtccatc

SEQ ID NO: 416527 - DNA, 27 bp, Artificial Sequence
  Description of Artificial Sequence: Synthetic oligonucleotide
gcttcacagtgcagaggcgagtccatc

SEQ ID NO: 416528 - DNA, 27 bp, Artificial Sequence
  Description of Artificial Sequence: Synthetic oligonucleotide
cttcacagtgcagaggcgagtccatcc

SEQ ID NO: 416529 - DNA, 28 bp, Artificial Sequence
  Description of Artificial Sequence: Synthetic oligonucleotide
ttcacagtgcagaggcgagtccatcctg

SEQ ID NO: 416530 - DNA, 27 bp, Artificial Sequence
  Description of Artificial Sequence: Synthetic oligonucleotide
tcacagtgcagaggcgagtccatcctg

SEQ ID NO: 416531 - DNA, 27 bp, Artificial Sequence
  Description of Artificial Sequence: Synthetic oligonucleotide
cacagtgcagaggcgagtccatcctga

SEQ ID NO: 416532 - DNA, 27 bp, Artificial Sequence
  Description of Artificial Sequence: Synthetic oligonucleotide
acagtgcagaggcgagtccatcctgag

SEQ ID NO: 416533 - DNA, 26 bp, Artificial Sequence
  Description of Artificial Sequence: Synthetic oligonucleotide
cagtgcagaggcgagtccatcctgag

SEQ ID NO: 416534 - DNA, 27 bp, Artificial Sequence
  Description of Artificial Sequence: Synthetic oligonucleotide
agtgcagaggcgagtccatcctgaggt

SEQ ID NO: 416535 - DNA, 26 bp, Artificial Sequence
  Description of Artificial Sequence: Synthetic oligonucleotide
gtgcagaggcgagtccatcctgaggt

SEQ ID NO: 416536 - DNA, 27 bp, Artificial Sequence
  Description of Artificial Sequence: Synthetic oligonucleotide
tgcagaggcgagtccatcctgaggtga

SEQ ID NO: 416537 - DNA, 26 bp, Artificial Sequence
  Description of Artificial Sequence: Synthetic oligonucleotide
gcagaggcgagtccatcctgaggtga

SEQ ID NO: 416538 - DNA, 27 bp, Artificial Sequence
  Description of Artificial Sequence: Synthetic oligonucleotide
cagaggcgagtccatcctgaggtgact

SEQ ID NO: 416539 - DNA, 27 bp, Artificial Sequence
  Description of Artificial Sequence: Synthetic oligonucleotide
agaggcgagtccatcctgaggtgactg

SEQ ID NO: 416540 - DNA, 27 bp, Artificial Sequence
  Description of Artificial Sequence: Synthetic oligonucleotide
gaggcgagtccatcctgaggtgactgt

SEQ ID NO: 416541 - DNA, 27 bp, Artificial Sequence
  Description of Artificial Sequence: Synthetic oligonucleotide
aggcgagtccatcctgaggtgactgtg

SEQ ID NO: 416542 - DNA, 36 bp, Artificial Sequence; identical to SEQ ID NO: 69515
  Description of Artificial Sequence: Synthetic oligonucleotide

SEQ ID NO: 416543 - DNA, 36 bp, Artificial Sequence; identical to SEQ ID NO: 69516
  Description of Artificial Sequence: Synthetic oligonucleotide

SEQ ID NO: 416544 - DNA, 35 bp, Artificial Sequence; identical to SEQ ID NO: 69517
  Description of Artificial Sequence: Synthetic oligonucleotide

SEQ ID NO: 416545 - DNA, 36 bp, Artificial Sequence; identical to SEQ ID NO: 69518
  Description of Artificial Sequence: Synthetic oligonucleotide

SEQ ID NO: 416546 - DNA, 36 bp, Artificial Sequence; identical to SEQ ID NO: 69519
  Description of Artificial Sequence: Synthetic oligonucleotide

SEQ ID NO: 416547 - DNA, 35 bp, Artificial Sequence; identical to SEQ ID NO: 69520
  Description of Artificial Sequence: Synthetic oligonucleotide

SEQ ID NO: 416548 - DNA, 34 bp, Artificial Sequence; identical to SEQ ID NO: 69521
  Description of Artificial Sequence: Synthetic oligonucleotide

SEQ ID NO: 416549 - DNA, 33 bp, Artificial Sequence; identical to SEQ ID NO: 69522
  Description of Artificial Sequence: Synthetic oligonucleotide

SEQ ID NO: 416550 - DNA, 32 bp, Artificial Sequence; identical to SEQ ID NO: 69523
  Description of Artificial Sequence: Synthetic oligonucleotide

SEQ ID NO: 416551 - DNA, 32 bp, Artificial Sequence; identical to SEQ ID NO: 69524
  Description of Artificial Sequence: Synthetic oligonucleotide

SEQ ID NO: 416552 - DNA, 31 bp, Artificial Sequence; identical to SEQ ID NO: 69525
  Description of Artificial Sequence: Synthetic oligonucleotide

SEQ ID NO: 416553 - DNA, 30 bp, Artificial Sequence; identical to SEQ ID NO: 69526
  Description of Artificial Sequence: Synthetic oligonucleotide

SEQ ID NO: 416554 - DNA, 29 bp, Artificial Sequence
  Description of Artificial Sequence: Synthetic oligonucleotide
gagtgtcatttcttcaacgggaccgagcg

SEQ ID NO: 416555 - DNA, 29 bp, Artificial Sequence
  Description of Artificial Sequence: Synthetic oligonucleotide
agtgtcatttcttcaacgggaccgagcgg

SEQ ID NO: 416556 - DNA, 28 bp, Artificial Sequence
  Description of Artificial Sequence: Synthetic oligonucleotide
gtgtcatttcttcaacgggaccgagcgg

SEQ ID NO: 416557 - DNA, 28 bp, Artificial Sequence
  Description of Artificial Sequence: Synthetic oligonucleotide
tgtcatttcttcaacgggaccgagcggg

SEQ ID NO: 416558 - DNA, 27 bp, Artificial Sequence
  Description of Artificial Sequence: Synthetic oligonucleotide
gtcatttcttcaacgggaccgagcggg

SEQ ID NO: 416559 - DNA, 28 bp, Artificial Sequence
  Description of Artificial Sequence: Synthetic oligonucleotide
tcatttcttcaacgggaccgagcgggtg

SEQ ID NO: 416560 - DNA, 27 bp, Artificial Sequence
  Description of Artificial Sequence: Synthetic oligonucleotide
catttcttcaacgggaccgagcgggtg

SEQ ID NO: 416561 - DNA, 27 bp, Artificial Sequence
  Description of Artificial Sequence: Synthetic oligonucleotide
atttcttcaacgggaccgagcgggtgc

SEQ ID NO: 416562 - DNA, 26 bp, Artificial Sequence
  Description of Artificial Sequence: Synthetic oligonucleotide
tttcttcaacgggaccgagcgggtgc

SEQ ID NO: 416563 - DNA, 25 bp, Artificial Sequence
  Description of Artificial Sequence: Synthetic oligonucleotide
ttcttcaacgggaccgagcgggtgc

SEQ ID NO: 416564 - DNA, 24 bp, Artificial Sequence
  Description of Artificial Sequence: Synthetic oligonucleotide
tcttcaacgggaccgagcgggtgc

SEQ ID NO: 416565 - DNA, 23 bp, Artificial Sequence
  Description of Artificial Sequence: Synthetic oligonucleotide
cttcaacgggaccgagcgggtgc

SEQ ID NO: 416566 - DNA, 23 bp, Artificial Sequence
  Description of Artificial Sequence: Synthetic oligonucleotide
ttcaacgggaccgagcgggtgcg

SEQ ID NO: 416567 - DNA, 22 bp, Artificial Sequence
  Description of Artificial Sequence: Synthetic oligonucleotide
tcaacgggaccgagcgggtgcg

SEQ ID NO: 416568 - DNA, 21 bp, Artificial Sequence
  Description of Artificial Sequence: Synthetic oligonucleotide
caacgggaccgagcgggtgcg

SEQ ID NO: 416569 - DNA, 24 bp, Artificial Sequence
  Description of Artificial Sequence: Synthetic oligonucleotide
aacgggaccgagcgggtgcggtat

SEQ ID NO: 416570 - DNA, 23 bp, Artificial Sequence
  Description of Artificial Sequence: Synthetic oligonucleotide
acgggaccgagcgggtgcggtat

SEQ ID NO: 416571 - DNA, 22 bp, Artificial Sequence
  Description of Artificial Sequence: Synthetic oligonucleotide
cgggaccgagcgggtgcggtat

SEQ ID NO: 416572 - DNA, 23 bp, Artificial Sequence
  Description of Artificial Sequence: Synthetic oligonucleotide
gggaccgagcgggtgcggtatct

SEQ ID NO: 416573 - DNA, 23 bp, Artificial Sequence
  Description of Artificial Sequence: Synthetic oligonucleotide
ggaccgagcgggtgcggtatctg

SEQ ID NO: 416574 - DNA, 24 bp, Artificial Sequence
  Description of Artificial Sequence: Synthetic oligonucleotide
gaccgagcgggtgcggtatctgca

SEQ ID NO: 416575 - DNA, 25 bp, Artificial Sequence
  Description of Artificial Sequence: Synthetic oligonucleotide
accgagcgggtgcggtatctgcaca

SEQ ID NO: 416576 - DNA, 24 bp, Artificial Sequence
  Description of Artificial Sequence: Synthetic oligonucleotide
ccgagcgggtgcggtatctgcaca

SEQ ID NO: 416577 - DNA, 25 bp, Artificial Sequence
  Description of Artificial Sequence: Synthetic oligonucleotide
cgagcgggtgcggtatctgcacaga

SEQ ID NO: 416578 - DNA, 32 bp, Artificial Sequence; identical to SEQ ID NO: 69551
  Description of Artificial Sequence: Synthetic oligonucleotide

SEQ ID NO: 416579 - DNA, 31 bp, Artificial Sequence; identical to SEQ ID NO: 69552
  Description of Artificial Sequence: Synthetic oligonucleotide

SEQ ID NO: 416580 - DNA, 31 bp, Artificial Sequence; identical to SEQ ID NO: 69553
  Description of Artificial Sequence: Synthetic oligonucleotide

SEQ ID NO: 416581 - DNA, 32 bp, Artificial Sequence; identical to SEQ ID NO: 69554
  Description of Artificial Sequence: Synthetic oligonucleotide

SEQ ID NO: 416582 - DNA, 32 bp, Artificial Sequence; identical to SEQ ID NO: 69555
  Description of Artificial Sequence: Synthetic oligonucleotide

SEQ ID NO: 416583 - DNA, 33 bp, Artificial Sequence; identical to SEQ ID NO: 69556
  Description of Artificial Sequence: Synthetic oligonucleotide

SEQ ID NO: 416584 - DNA, 32 bp, Artificial Sequence; identical to SEQ ID NO: 69557
  Description of Artificial Sequence: Synthetic oligonucleotide

SEQ ID NO: 416585 - DNA, 31 bp, Artificial Sequence; identical to SEQ ID NO: 69558
  Description of Artificial Sequence: Synthetic oligonucleotide

SEQ ID NO: 416586 - DNA, 30 bp, Artificial Sequence; identical to SEQ ID NO: 69559
  Description of Artificial Sequence: Synthetic oligonucleotide

SEQ ID NO: 416587 - DNA, 32 bp, Artificial Sequence; identical to SEQ ID NO: 69560
  Description of Artificial Sequence: Synthetic oligonucleotide

SEQ ID NO: 416588 - DNA, 31 bp, Artificial Sequence; identical to SEQ ID NO: 69561
  Description of Artificial Sequence: Synthetic oligonucleotide

SEQ ID NO: 416589 - DNA, 31 bp, Artificial Sequence; identical to SEQ ID NO: 69562
  Description of Artificial Sequence: Synthetic oligonucleotide

SEQ ID NO: 416590 - DNA, 32 bp, Artificial Sequence; identical to SEQ ID NO: 69563
  Description of Artificial Sequence: Synthetic oligonucleotide

SEQ ID NO: 416591 - DNA, 31 bp, Artificial Sequence; identical to SEQ ID NO: 69564
  Description of Artificial Sequence: Synthetic oligonucleotide

SEQ ID NO: 416592 - DNA, 31 bp, Artificial Sequence; identical to SEQ ID NO: 69565
  Description of Artificial Sequence: Synthetic oligonucleotide

SEQ ID NO: 416593 - DNA, 30 bp, Artificial Sequence; identical to SEQ ID NO: 69566
  Description of Artificial Sequence: Synthetic oligonucleotide

SEQ ID NO: 416594 - DNA, 30 bp, Artificial Sequence; identical to SEQ ID NO: 69567
  Description of Artificial Sequence: Synthetic oligonucleotide

SEQ ID NO: 416595 - DNA, 29 bp, Artificial Sequence
  Description of Artificial Sequence: Synthetic oligonucleotide
ggcatctataaccaggaggagaacgtgcg

SEQ ID NO: 416596 - DNA, 29 bp, Artificial Sequence
  Description of Artificial Sequence: Synthetic oligonucleotide
gcatctataaccaggaggagaacgtgcgc

SEQ ID NO: 416597 - DNA, 31 bp, Artificial Sequence; identical to SEQ ID NO: 69570
  Description of Artificial Sequence: Synthetic oligonucleotide

SEQ ID NO: 416598 - DNA, 31 bp, Artificial Sequence; identical to SEQ ID NO: 69571
  Description of Artificial Sequence: Synthetic oligonucleotide

SEQ ID NO: 416599 - DNA, 30 bp, Artificial Sequence; identical to SEQ ID NO: 69572
  Description of Artificial Sequence: Synthetic oligonucleotide

SEQ ID NO: 416600 - DNA, 29 bp, Artificial Sequence
  Description of Artificial Sequence: Synthetic oligonucleotide
ctataaccaggaggagaacgtgcgcttcg

SEQ ID NO: 416601 - DNA, 30 bp, Artificial Sequence; identical to SEQ ID NO: 69574
  Description of Artificial Sequence: Synthetic oligonucleotide

SEQ ID NO: 416602 - DNA, 21 bp, Artificial Sequence
  Description of Artificial Sequence: Synthetic oligonucleotide
gacgtgggggagtaccgggcc

SEQ ID NO: 416603 - DNA, 22 bp, Artificial Sequence
  Description of Artificial Sequence: Synthetic oligonucleotide
acgtgggggagtaccgggccgt

SEQ ID NO: 416604 - DNA, 21 bp, Artificial Sequence
  Description of Artificial Sequence: Synthetic oligonucleotide
cgtgggggagtaccgggccgt

SEQ ID NO: 416605 - DNA, 22 bp, Artificial Sequence
  Description of Artificial Sequence: Synthetic oligonucleotide
gtgggggagtaccgggccgtga

SEQ ID NO: 416606 - DNA, 22 bp, Artificial Sequence
  Description of Artificial Sequence: Synthetic oligonucleotide
tgggggagtaccgggccgtgac

SEQ ID NO: 416607 - DNA, 21 bp, Artificial Sequence
  Description of Artificial Sequence: Synthetic oligonucleotide
gggggagtaccgggccgtgac

SEQ ID NO: 416608 - DNA, 21 bp, Artificial Sequence
  Description of Artificial Sequence: Synthetic oligonucleotide
ggggagtaccgggccgtgacg

SEQ ID NO: 416609 - DNA, 22 bp, Artificial Sequence
  Description of Artificial Sequence: Synthetic oligonucleotide
gggagtaccgggccgtgacgga

SEQ ID NO: 416610 - DNA, 22 bp, Artificial Sequence
  Description of Artificial Sequence: Synthetic oligonucleotide
ggagtaccgggccgtgacggag

SEQ ID NO: 416611 - DNA, 23 bp, Artificial Sequence
  Description of Artificial Sequence: Synthetic oligonucleotide
gagtaccgggccgtgacggagct

SEQ ID NO: 416612 - DNA, 23 bp, Artificial Sequence
  Description of Artificial Sequence: Synthetic oligonucleotide
agtaccgggccgtgacggagctg

SEQ ID NO: 416613 - DNA, 22 bp, Artificial Sequence
  Description of Artificial Sequence: Synthetic oligonucleotide
gtaccgggccgtgacggagctg

SEQ ID NO: 416614 - DNA, 22 bp, Artificial Sequence
  Description of Artificial Sequence: Synthetic oligonucleotide
taccgggccgtgacggagctgg

SEQ ID NO: 416615 - DNA, 21 bp, Artificial Sequence
  Description of Artificial Sequence: Synthetic oligonucleotide
accgggccgtgacggagctgg

SEQ ID NO: 416616 - DNA, 20 bp, Artificial Sequence
  Description of Artificial Sequence: Synthetic oligonucleotide
ccgggccgtgacggagctgg

SEQ ID NO: 416617 - DNA, 20 bp, Artificial Sequence
  Description of Artificial Sequence: Synthetic oligonucleotide
cgggccgtgacggagctggg

SEQ ID NO: 416618 - DNA, 20 bp, Artificial Sequence
  Description of Artificial Sequence: Synthetic oligonucleotide
gggccgtgacggagctgggg

SEQ ID NO: 416619 - DNA, 20 bp, Artificial Sequence
  Description of Artificial Sequence: Synthetic oligonucleotide
ggccgtgacggagctggggc

SEQ ID NO: 416620 - DNA, 20 bp, Artificial Sequence
  Description of Artificial Sequence: Synthetic oligonucleotide
gccgtgacggagctggggcg

SEQ ID NO: 416621 - DNA, 20 bp, Artificial Sequence
  Description of Artificial Sequence: Synthetic oligonucleotide
ccgtgacggagctggggcgg

SEQ ID NO: 416622 - DNA, 20 bp, Artificial Sequence
  Description of Artificial Sequence: Synthetic oligonucleotide
cgtgacggagctggggcggc

SEQ ID NO: 416623 - DNA, 29 bp, Artificial Sequence
  Description of Artificial Sequence: Synthetic oligonucleotide
aacagccagaaggacttcctggagcgaag

SEQ ID NO: 416624 - DNA, 28 bp, Artificial Sequence
  Description of Artificial Sequence: Synthetic oligonucleotide
acagccagaaggacttcctggagcgaag

SEQ ID NO: 416625 - DNA, 27 bp, Artificial Sequence
  Description of Artificial Sequence: Synthetic oligonucleotide
cagccagaaggacttcctggagcgaag

SEQ ID NO: 416626 - DNA, 27 bp, Artificial Sequence
  Description of Artificial Sequence: Synthetic oligonucleotide
agccagaaggacttcctggagcgaagg

SEQ ID NO: 416627 - DNA, 26 bp, Artificial Sequence
  Description of Artificial Sequence: Synthetic oligonucleotide
gccagaaggacttcctggagcgaagg

SEQ ID NO: 416628 - DNA, 26 bp, Artificial Sequence
  Description of Artificial Sequence: Synthetic oligonucleotide
ccagaaggacttcctggagcgaaggc

SEQ ID NO: 416629 - DNA, 26 bp, Artificial Sequence
  Description of Artificial Sequence: Synthetic oligonucleotide
cagaaggacttcctggagcgaaggcg

SEQ ID NO: 416630 - DNA, 26 bp, Artificial Sequence
  Description of Artificial Sequence: Synthetic oligonucleotide
agaaggacttcctggagcgaaggcgg

SEQ ID NO: 416631 - DNA, 25 bp, Artificial Sequence
  Description of Artificial Sequence: Synthetic oligonucleotide
gaaggacttcctggagcgaaggcgg

SEQ ID NO: 416632 - DNA, 25 bp, Artificial Sequence
  Description of Artificial Sequence: Synthetic oligonucleotide
aaggacttcctggagcgaaggcggg

SEQ ID NO: 416633 - DNA, 24 bp, Artificial Sequence
  Description of Artificial Sequence: Synthetic oligonucleotide
aggacttcctggagcgaaggcggg

SEQ ID NO: 416634 - DNA, 23 bp, Artificial Sequence
  Description of Artificial Sequence: Synthetic oligonucleotide
ggacttcctggagcgaaggcggg

SEQ ID NO: 416635 - DNA, 23 bp, Artificial Sequence
  Description of Artificial Sequence: Synthetic oligonucleotide
gacttcctggagcgaaggcgggc

SEQ ID NO: 416636 - DNA, 23 bp, Artificial Sequence
  Description of Artificial Sequence: Synthetic oligonucleotide
acttcctggagcgaaggcgggcc

SEQ ID NO: 416637 - DNA, 22 bp, Artificial Sequence
  Description of Artificial Sequence: Synthetic oligonucleotide
cttcctggagcgaaggcgggcc

SEQ ID NO: 416638 - DNA, 23 bp, Artificial Sequence
  Description of Artificial Sequence: Synthetic oligonucleotide
ttcctggagcgaaggcgggccga

SEQ ID NO: 416639 - DNA, 22 bp, Artificial Sequence
  Description of Artificial Sequence: Synthetic oligonucleotide
tcctggagcgaaggcgggccga

SEQ ID NO: 416640 - DNA, 21 bp, Artificial Sequence
  Description of Artificial Sequence: Synthetic oligonucleotide
cctggagcgaaggcgggccga

SEQ ID NO: 416641 - DNA, 21 bp, Artificial Sequence
  Description of Artificial Sequence: Synthetic oligonucleotide
ctggagcgaaggcgggccgag

SEQ ID NO: 416642 - DNA, 22 bp, Artificial Sequence
  Description of Artificial Sequence: Synthetic oligonucleotide
tggagcgaaggcgggccgaggt

SEQ ID NO: 416643 - DNA, 21 bp, Artificial Sequence
  Description of Artificial Sequence: Synthetic oligonucleotide
ggagcgaaggcgggccgaggt

SEQ ID NO: 416644 - DNA, 21 bp, Artificial Sequence
  Description of Artificial Sequence: Synthetic oligonucleotide
gagcgaaggcgggccgaggtg

SEQ ID NO: 416645 - DNA, 22 bp, Artificial Sequence
  Description of Artificial Sequence: Synthetic oligonucleotide
agcgaaggcgggccgaggtgga

SEQ ID NO: 416646 - DNA, 21 bp, Artificial Sequence
  Description of Artificial Sequence: Synthetic oligonucleotide
gcgaaggcgggccgaggtgga

SEQ ID NO: 416647 - DNA, 22 bp, Artificial Sequence
  Description of Artificial Sequence: Synthetic oligonucleotide
cgaaggcgggccgaggtggaca

SEQ ID NO: 416648 - DNA, 22 bp, Artificial Sequence
  Description of Artificial Sequence: Synthetic oligonucleotide
gaaggcgggccgaggtggacac

SEQ ID NO: 416649 - DNA, 22 bp, Artificial Sequence
  Description of Artificial Sequence: Synthetic oligonucleotide
aaggcgggccgaggtggacacc

SEQ ID NO: 416650 - DNA, 23 bp, Artificial Sequence
  Description of Artificial Sequence: Synthetic oligonucleotide
acttcctggagcggaggcgggct

SEQ ID NO: 416651 - DNA, 22 bp, Artificial Sequence
  Description of Artificial Sequence: Synthetic oligonucleotide
cttcctggagcggaggcgggct

SEQ ID NO: 416652 - DNA, 23 bp, Artificial Sequence
  Description of Artificial Sequence: Synthetic oligonucleotide
ttcctggagcggaggcgggctga

SEQ ID NO: 416653 - DNA, 22 bp, Artificial Sequence
  Description of Artificial Sequence: Synthetic oligonucleotide
tcctggagcggaggcgggctga

SEQ ID NO: 416654 - DNA, 21 bp, Artificial Sequence
  Description of Artificial Sequence: Synthetic oligonucleotide
cctggagcggaggcgggctga

SEQ ID NO: 416655 - DNA, 21 bp, Artificial Sequence
  Description of Artificial Sequence: Synthetic oligonucleotide
ctggagcggaggcgggctgag

SEQ ID NO: 416656 - DNA, 22 bp, Artificial Sequence
  Description of Artificial Sequence: Synthetic oligonucleotide
tggagcggaggcgggctgaggt

SEQ ID NO: 416657 - DNA, 21 bp, Artificial Sequence
  Description of Artificial Sequence: Synthetic oligonucleotide
ggagcggaggcgggctgaggt

SEQ ID NO: 416658 - DNA, 21 bp, Artificial Sequence
  Description of Artificial Sequence: Synthetic oligonucleotide
gagcggaggcgggctgaggtg

SEQ ID NO: 416659 - DNA, 22 bp, Artificial Sequence
  Description of Artificial Sequence: Synthetic oligonucleotide
agcggaggcgggctgaggtgga

SEQ ID NO: 416660 - DNA, 21 bp, Artificial Sequence
  Description of Artificial Sequence: Synthetic oligonucleotide
gcggaggcgggctgaggtgga

SEQ ID NO: 416661 - DNA, 22 bp, Artificial Sequence
  Description of Artificial Sequence: Synthetic oligonucleotide
cggaggcgggctgaggtggaca

SEQ ID NO: 416662 - DNA, 22 bp, Artificial Sequence
  Description of Artificial Sequence: Synthetic oligonucleotide
ggaggcgggctgaggtggacac

SEQ ID NO: 416663 - DNA, 22 bp, Artificial Sequence
  Description of Artificial Sequence: Synthetic oligonucleotide
gaggcgggctgaggtggacacc

SEQ ID NO: 416664 - DNA, 23 bp, Artificial Sequence
  Description of Artificial Sequence: Synthetic oligonucleotide
aggcgggctgaggtggacaccgt

SEQ ID NO: 416665 - DNA, 22 bp, Artificial Sequence
  Description of Artificial Sequence: Synthetic oligonucleotide
ggcgggctgaggtggacaccgt

SEQ ID NO: 416666 - DNA, 23 bp, Artificial Sequence
  Description of Artificial Sequence: Synthetic oligonucleotide
gcgggctgaggtggacaccgtgt

SEQ ID NO: 416667 - DNA, 23 bp, Artificial Sequence
  Description of Artificial Sequence: Synthetic oligonucleotide
cgggctgaggtggacaccgtgtg

SEQ ID NO: 416668 - DNA, 24 bp, Artificial Sequence
  Description of Artificial Sequence: Synthetic oligonucleotide
gggctgaggtggacaccgtgtgca

SEQ ID NO: 416669 - DNA, 25 bp, Artificial Sequence
  Description of Artificial Sequence: Synthetic oligonucleotide
ggctgaggtggacaccgtgtgcaga

SEQ ID NO: 416670 - DNA, 26 bp, Artificial Sequence
  Description of Artificial Sequence: Synthetic oligonucleotide
gctgaggtggacaccgtgtgcagaca

SEQ ID NO: 416671 - DNA, 27 bp, Artificial Sequence
  Description of Artificial Sequence: Synthetic oligonucleotide
ctgaggtggacaccgtgtgcagacaca

SEQ ID NO: 416672 - DNA, 28 bp, Artificial Sequence
  Description of Artificial Sequence: Synthetic oligonucleotide
tgaggtggacaccgtgtgcagacacaac

SEQ ID NO: 416673 - DNA, 25 bp, Artificial Sequence
  Description of Artificial Sequence: Synthetic oligonucleotide
acttcctggaagacaggcgcgccga

SEQ ID NO: 416674 - DNA, 24 bp, Artificial Sequence
  Description of Artificial Sequence: Synthetic oligonucleotide
cttcctggaagacaggcgcgccga

SEQ ID NO: 416675 - DNA, 24 bp, Artificial Sequence
  Description of Artificial Sequence: Synthetic oligonucleotide
ttcctggaagacaggcgcgccgag

SEQ ID NO: 416676 - DNA, 23 bp, Artificial Sequence
  Description of Artificial Sequence: Synthetic oligonucleotide
tcctggaagacaggcgcgccgag

SEQ ID NO: 416677 - DNA, 22 bp, Artificial Sequence
  Description of Artificial Sequence: Synthetic oligonucleotide
cctggaagacaggcgcgccgag

SEQ ID NO: 416678 - DNA, 23 bp, Artificial Sequence
  Description of Artificial Sequence: Synthetic oligonucleotide
ctggaagacaggcgcgccgaggt

SEQ ID NO: 416679 - DNA, 23 bp, Artificial Sequence
  Description of Artificial Sequence: Synthetic oligonucleotide
tggaagacaggcgcgccgaggtg

SEQ ID NO: 416680 - DNA, 22 bp, Artificial Sequence
  Description of Artificial Sequence: Synthetic oligonucleotide
ggaagacaggcgcgccgaggtg

SEQ ID NO: 416681 - DNA, 23 bp, Artificial Sequence
  Description of Artificial Sequence: Synthetic oligonucleotide
gaagacaggcgcgccgaggtgga

SEQ ID NO: 416682 - DNA, 24 bp, Artificial Sequence
  Description of Artificial Sequence: Synthetic oligonucleotide
aagacaggcgcgccgaggtggaca

SEQ ID NO: 416683 - DNA, 23 bp, Artificial Sequence
  Description of Artificial Sequence: Synthetic oligonucleotide
agacaggcgcgccgaggtggaca

SEQ ID NO: 416684 - DNA, 22 bp, Artificial Sequence
  Description of Artificial Sequence: Synthetic oligonucleotide
gacaggcgcgccgaggtggaca

SEQ ID NO: 416685 - DNA, 22 bp, Artificial Sequence
  Description of Artificial Sequence: Synthetic oligonucleotide
acaggcgcgccgaggtggacac

SEQ ID NO: 416686 - DNA, 21 bp, Artificial Sequence
  Description of Artificial Sequence: Synthetic oligonucleotide
caggcgcgccgaggtggacac

SEQ ID NO: 416687 - DNA, 21 bp, Artificial Sequence
  Description of Artificial Sequence: Synthetic oligonucleotide
aggcgcgccgaggtggacacc

SEQ ID NO: 416688 - DNA, 20 bp, Artificial Sequence
  Description of Artificial Sequence: Synthetic oligonucleotide
ggcgcgccgaggtggacacc

SEQ ID NO: 416689 - DNA, 21 bp, Artificial Sequence
  Description of Artificial Sequence: Synthetic oligonucleotide
gcgcgccgaggtggacaccgt

SEQ ID NO: 416690 - DNA, 22 bp, Artificial Sequence
  Description of Artificial Sequence: Synthetic oligonucleotide
cgcgccgaggtggacaccgtgt

SEQ ID NO: 416691 - DNA, 22 bp, Artificial Sequence
  Description of Artificial Sequence: Synthetic oligonucleotide
gcgccgaggtggacaccgtgtg

SEQ ID NO: 416692 - DNA, 23 bp, Artificial Sequence
  Description of Artificial Sequence: Synthetic oligonucleotide
cgccgaggtggacaccgtgtgca

SEQ ID NO: 416693 - DNA, 28 bp, Artificial Sequence
  Description of Artificial Sequence: Synthetic oligonucleotide
cgtgtgcagacacaactacggggttgtg

SEQ ID NO: 416694 - DNA, 28 bp, Artificial Sequence
  Description of Artificial Sequence: Synthetic oligonucleotide
gtgtgcagacacaactacggggttgtgg

SEQ ID NO: 416695 - DNA, 29 bp, Artificial Sequence
  Description of Artificial Sequence: Synthetic oligonucleotide
tgtgcagacacaactacggggttgtggag

SEQ ID NO: 416696 - DNA, 28 bp, Artificial Sequence
  Description of Artificial Sequence: Synthetic oligonucleotide
gtgcagacacaactacggggttgtggag

SEQ ID NO: 416697 - DNA, 28 bp, Artificial Sequence
  Description of Artificial Sequence: Synthetic oligonucleotide
gggttgtggagagcttcacagtgcagag

SEQ ID NO: 416698 - DNA, 28 bp, Artificial Sequence
  Description of Artificial Sequence: Synthetic oligonucleotide
ggttgtggagagcttcacagtgcagagg

SEQ ID NO: 416699 - DNA, 28 bp, Artificial Sequence
  Description of Artificial Sequence: Synthetic oligonucleotide
gttgtggagagcttcacagtgcagaggc

SEQ ID NO: 416700 - DNA, 28 bp, Artificial Sequence
  Description of Artificial Sequence: Synthetic oligonucleotide
ttgtggagagcttcacagtgcagaggcg

SEQ ID NO: 416701 - DNA, 27 bp, Artificial Sequence
  Description of Artificial Sequence: Synthetic oligonucleotide
tgtggagagcttcacagtgcagaggcg

SEQ ID NO: 416702 - DNA, 27 bp, Artificial Sequence
  Description of Artificial Sequence: Synthetic oligonucleotide
gtggagagcttcacagtgcagaggcga

SEQ ID NO: 416703 - DNA, 27 bp, Artificial Sequence
  Description of Artificial Sequence: Synthetic oligonucleotide
tggagagcttcacagtgcagaggcgag

SEQ ID NO: 416704 - DNA, 38 bp, Artificial Sequence; identical to SEQ ID NO: 69680
  Description of Artificial Sequence: Synthetic oligonucleotide

SEQ ID NO: 416705 - DNA, 40 bp, Artificial Sequence; identical to SEQ ID NO: 69681
  Description of Artificial Sequence: Synthetic oligonucleotide

SEQ ID NO: 416706 - DNA, 39 bp, Artificial Sequence; identical to SEQ ID NO: 69682
  Description of Artificial Sequence: Synthetic oligonucleotide

SEQ ID NO: 416707 - DNA, 41 bp, Artificial Sequence; identical to SEQ ID NO: 69683
  Description of Artificial Sequence: Synthetic oligonucleotide

SEQ ID NO: 416708 - DNA, 41 bp, Artificial Sequence; identical to SEQ ID NO: 69684
  Description of Artificial Sequence: Synthetic oligonucleotide

SEQ ID NO: 416709 - DNA, 40 bp, Artificial Sequence; identical to SEQ ID NO: 69685
  Description of Artificial Sequence: Synthetic oligonucleotide

SEQ ID NO: 416710 - DNA, 39 bp, Artificial Sequence; identical to SEQ ID NO: 69686
  Description of Artificial Sequence: Synthetic oligonucleotide

SEQ ID NO: 416711 - DNA, 38 bp, Artificial Sequence; identical to SEQ ID NO: 69687
  Description of Artificial Sequence: Synthetic oligonucleotide

SEQ ID NO: 416712 - DNA, 38 bp, Artificial Sequence; identical to SEQ ID NO: 69688
  Description of Artificial Sequence: Synthetic oligonucleotide

SEQ ID NO: 416713 - DNA, 37 bp, Artificial Sequence; identical to SEQ ID NO: 69689
  Description of Artificial Sequence: Synthetic oligonucleotide

SEQ ID NO: 416714 - DNA, 36 bp, Artificial Sequence; identical to SEQ ID NO: 69690
  Description of Artificial Sequence: Synthetic oligonucleotide

SEQ ID NO: 416715 - DNA, 36 bp, Artificial Sequence; identical to SEQ ID NO: 69691
  Description of Artificial Sequence: Synthetic oligonucleotide

SEQ ID NO: 416716 - DNA, 37 bp, Artificial Sequence; identical to SEQ ID NO: 69692
  Description of Artificial Sequence: Synthetic oligonucleotide

SEQ ID NO: 416717 - DNA, 36 bp, Artificial Sequence; identical to SEQ ID NO: 69693
  Description of Artificial Sequence: Synthetic oligonucleotide

SEQ ID NO: 416718 - DNA, 36 bp, Artificial Sequence; identical to SEQ ID NO: 69694
  Description of Artificial Sequence: Synthetic oligonucleotide

SEQ ID NO: 416719 - DNA, 36 bp, Artificial Sequence; identical to SEQ ID NO: 69695
  Description of Artificial Sequence: Synthetic oligonucleotide

SEQ ID NO: 416720 - DNA, 35 bp, Artificial Sequence; identical to SEQ ID NO: 69696
  Description of Artificial Sequence: Synthetic oligonucleotide

SEQ ID NO: 416721 - DNA, 36 bp, Artificial Sequence; identical to SEQ ID NO: 69697
  Description of Artificial Sequence: Synthetic oligonucleotide

SEQ ID NO: 416722 - DNA, 36 bp, Artificial Sequence; identical to SEQ ID NO: 69698
  Description of Artificial Sequence: Synthetic oligonucleotide

SEQ ID NO: 416723 - DNA, 35 bp, Artificial Sequence; identical to SEQ ID NO: 69699
  Description of Artificial Sequence: Synthetic oligonucleotide

SEQ ID NO: 416724 - DNA, 34 bp, Artificial Sequence; identical to SEQ ID NO: 69700
  Description of Artificial Sequence: Synthetic oligonucleotide

SEQ ID NO: 416725 - DNA, 33 bp, Artificial Sequence; identical to SEQ ID NO: 69701
  Description of Artificial Sequence: Synthetic oligonucleotide

SEQ ID NO: 416726 - DNA, 32 bp, Artificial Sequence; identical to SEQ ID NO: 69702
  Description of Artificial Sequence: Synthetic oligonucleotide

SEQ ID NO: 416727 - DNA, 31 bp, Artificial Sequence; identical to SEQ ID NO: 69716
  Description of Artificial Sequence: Synthetic oligonucleotide

SEQ ID NO: 416728 - DNA, 30 bp, Artificial Sequence; identical to SEQ ID NO: 69717
  Description of Artificial Sequence: Synthetic oligonucleotide

SEQ ID NO: 416729 - DNA, 30 bp, Artificial Sequence; identical to SEQ ID NO: 69718
  Description of Artificial Sequence: Synthetic oligonucleotide

SEQ ID NO: 416730 - DNA, 29 bp, Artificial Sequence
  Description of Artificial Sequence: Synthetic oligonucleotide
gcagacacaactacggggttggtgaatgc

SEQ ID NO: 416731 - DNA, 31 bp, Artificial Sequence; identical to SEQ ID NO: 69720
  Description of Artificial Sequence: Synthetic oligonucleotide

SEQ ID NO: 416732 - DNA, 32 bp, Artificial Sequence; identical to SEQ ID NO: 69721
  Description of Artificial Sequence: Synthetic oligonucleotide

SEQ ID NO: 416733 - DNA, 31 bp, Artificial Sequence; identical to SEQ ID NO: 69722
  Description of Artificial Sequence: Synthetic oligonucleotide

SEQ ID NO: 416734 - DNA, 32 bp, Artificial Sequence; identical to SEQ ID NO: 69723
  Description of Artificial Sequence: Synthetic oligonucleotide

SEQ ID NO: 416735 - DNA, 31 bp, Artificial Sequence; identical to SEQ ID NO: 69724
  Description of Artificial Sequence: Synthetic oligonucleotide

SEQ ID NO: 416736 - DNA, 32 bp, Artificial Sequence; identical to SEQ ID NO: 69725
  Description of Artificial Sequence: Synthetic oligonucleotide

SEQ ID NO: 416737 - DNA, 31 bp, Artificial Sequence; identical to SEQ ID NO: 69726
  Description of Artificial Sequence: Synthetic oligonucleotide

SEQ ID NO: 416738 - DNA, 31 bp, Artificial Sequence; identical to SEQ ID NO: 69727
  Description of Artificial Sequence: Synthetic oligonucleotide

SEQ ID NO: 416739 - DNA, 30 bp, Artificial Sequence; identical to SEQ ID NO: 69728
  Description of Artificial Sequence: Synthetic oligonucleotide

SEQ ID NO: 416740 - DNA, 29 bp, Artificial Sequence
  Description of Artificial Sequence: Synthetic oligonucleotide
ctacggggttggtgaatgcttcacagtgc

SEQ ID NO: 416741 - DNA, 30 bp, Artificial Sequence; identical to SEQ ID NO: 69730
  Description of Artificial Sequence: Synthetic oligonucleotide

SEQ ID NO: 416742 - DNA, 29 bp, Artificial Sequence
  Description of Artificial Sequence: Synthetic oligonucleotide
acggggttggtgaatgcttcacagtgcag

SEQ ID NO: 416743 - DNA, 28 bp, Artificial Sequence
  Description of Artificial Sequence: Synthetic oligonucleotide
cggggttggtgaatgcttcacagtgcag

SEQ ID NO: 416744 - DNA, 29 bp, Artificial Sequence
  Description of Artificial Sequence: Synthetic oligonucleotide
ggggttggtgaatgcttcacagtgcagag

SEQ ID NO: 416745 - DNA, 29 bp, Artificial Sequence
  Description of Artificial Sequence: Synthetic oligonucleotide
gggttggtgaatgcttcacagtgcagagg

SEQ ID NO: 416746 - DNA, 29 bp, Artificial Sequence
  Description of Artificial Sequence: Synthetic oligonucleotide
ggttggtgaatgcttcacagtgcagaggc

SEQ ID NO: 416747 - DNA, 29 bp, Artificial Sequence
  Description of Artificial Sequence: Synthetic oligonucleotide
gttggtgaatgcttcacagtgcagaggcg

SEQ ID NO: 416748 - DNA, 30 bp, Artificial Sequence; identical to SEQ ID NO: 69737
  Description of Artificial Sequence: Synthetic oligonucleotide

SEQ ID NO: 416749 - DNA, 26 bp, Artificial Sequence
  Description of Artificial Sequence: Synthetic oligonucleotide
gagcgggtgcggtatctgcacagaga

SEQ ID NO: 416750 - DNA, 27 bp, Artificial Sequence
  Description of Artificial Sequence: Synthetic oligonucleotide
agcgggtgcggtatctgcacagagaca

SEQ ID NO: 416751 - DNA, 27 bp, Artificial Sequence
  Description of Artificial Sequence: Synthetic oligonucleotide
gcgggtgcggtatctgcacagagacat

SEQ ID NO: 416752 - DNA, 27 bp, Artificial Sequence
  Description of Artificial Sequence: Synthetic oligonucleotide
cgggtgcggtatctgcacagagacatc

SEQ ID NO: 416753 - DNA, 32 bp, Artificial Sequence
  Description of Artificial Sequence: Synthetic oligonucleotide
gggtgcggtatctgcacagagacatctataac

SEQ ID NO: 416754 - DNA, 32 bp, Artificial Sequence
  Description of Artificial Sequence: Synthetic oligonucleotide
ggtgcggtatctgcacagagacatctataacc

SEQ ID NO: 416755 - DNA, 34 bp, Artificial Sequence
  Description of Artificial Sequence: Synthetic oligonucleotide
gtgcggtatctgcacagagacatctataaccaag

SEQ ID NO: 416756 - DNA, 35 bp, Artificial Sequence
  Description of Artificial Sequence: Synthetic oligonucleotide
tgcggtatctgcacagagacatctataaccaagag

SEQ ID NO: 416757 - DNA, 34 bp, Artificial Sequence
  Description of Artificial Sequence: Synthetic oligonucleotide
gcggtatctgcacagagacatctataaccaagag

SEQ ID NO: 416758 - DNA, 34 bp, Artificial Sequence
  Description of Artificial Sequence: Synthetic oligonucleotide
cggtatctgcacagagacatctataaccaagagg

SEQ ID NO: 416759 - DNA, 35 bp, Artificial Sequence
  Description of Artificial Sequence: Synthetic oligonucleotide
ggtatctgcacagagacatctataaccaagaggag

SEQ ID NO: 416760 - DNA, 37 bp, Artificial Sequence
  Description of Artificial Sequence: Synthetic oligonucleotide
gtatctgcacagagacatctataaccaagaggagaac

SEQ ID NO: 416761 - DNA, 37 bp, Artificial Sequence
  Description of Artificial Sequence: Synthetic oligonucleotide
tatctgcacagagacatctataaccaagaggagaacg

SEQ ID NO: 416762 - DNA, 36 bp, Artificial Sequence
  Description of Artificial Sequence: Synthetic oligonucleotide
atctgcacagagacatctataaccaagaggagaacg

SEQ ID NO: 416763 - DNA, 35 bp, Artificial Sequence
  Description of Artificial Sequence: Synthetic oligonucleotide
tctgcacagagacatctataaccaagaggagaacg

SEQ ID NO: 416764 - DNA, 34 bp, Artificial Sequence
  Description of Artificial Sequence: Synthetic oligonucleotide
ctgcacagagacatctataaccaagaggagaacg

SEQ ID NO: 416765 - DNA, 35 bp, Artificial Sequence
  Description of Artificial Sequence: Synthetic oligonucleotide
tgcacagagacatctataaccaagaggagaacgtg

SEQ ID NO: 416766 - DNA, 34 bp, Artificial Sequence
  Description of Artificial Sequence: Synthetic oligonucleotide
gcacagagacatctataaccaagaggagaacgtg

SEQ ID NO: 416767 - DNA, 34 bp, Artificial Sequence
  Description of Artificial Sequence: Synthetic oligonucleotide
cacagagacatctataaccaagaggagaacgtgc

SEQ ID NO: 416768 - DNA, 34 bp, Artificial Sequence
  Description of Artificial Sequence: Synthetic oligonucleotide
acagagacatctataaccaagaggagaacgtgcg

SEQ ID NO: 416769 - DNA, 33 bp, Artificial Sequence
  Description of Artificial Sequence: Synthetic oligonucleotide
cagagacatctataaccaagaggagaacgtgcg

SEQ ID NO: 416770 - DNA, 33 bp, Artificial Sequence
  Description of Artificial Sequence: Synthetic oligonucleotide
agagacatctataaccaagaggagaacgtgcgc

SEQ ID NO: 416771 - DNA, 32 bp, Artificial Sequence
  Description of Artificial Sequence: Synthetic oligonucleotide
gagacatctataaccaagaggagaacgtgcgc

SEQ ID NO: 416772 - DNA, 34 bp, Artificial Sequence
  Description of Artificial Sequence: Synthetic oligonucleotide
agacatctataaccaagaggagaacgtgcgcttc

SEQ ID NO: 416773 - DNA, 33 bp, Artificial Sequence
  Description of Artificial Sequence: Synthetic oligonucleotide
gacatctataaccaagaggagaacgtgcgcttc

SEQ ID NO: 416774 - DNA, 33 bp, Artificial Sequence
  Description of Artificial Sequence: Synthetic oligonucleotide
acatctataaccaagaggagaacgtgcgcttcg

SEQ ID NO: 416775 - DNA, 25 bp, Artificial Sequence
  Description of Artificial Sequence: Synthetic oligonucleotide
gagaacgtgcgcttcgacagcgacg

SEQ ID NO: 416776 - DNA, 25 bp, Artificial Sequence
  Description of Artificial Sequence: Synthetic oligonucleotide
agaacgtgcgcttcgacagcgacgg

SEQ ID NO: 416777 - DNA, 24 bp, Artificial Sequence
  Description of Artificial Sequence: Synthetic oligonucleotide
gaacgtgcgcttcgacagcgacgg

SEQ ID NO: 416778 - DNA, 24 bp, Artificial Sequence
  Description of Artificial Sequence: Synthetic oligonucleotide
aacgtgcgcttcgacagcgacggg

SEQ ID NO: 416779 - DNA, 23 bp, Artificial Sequence
  Description of Artificial Sequence: Synthetic oligonucleotide
acgtgcgcttcgacagcgacggg

SEQ ID NO: 416780 - DNA, 22 bp, Artificial Sequence
  Description of Artificial Sequence: Synthetic oligonucleotide
cgtgcgcttcgacagcgacggg

SEQ ID NO: 416781 - DNA, 22 bp, Artificial Sequence
  Description of Artificial Sequence: Synthetic oligonucleotide
gtgcgcttcgacagcgacgggg

SEQ ID NO: 416782 - DNA, 22 bp, Artificial Sequence
  Description of Artificial Sequence: Synthetic oligonucleotide
tgcgcttcgacagcgacggggg

SEQ ID NO: 416783 - DNA, 21 bp, Artificial Sequence
  Description of Artificial Sequence: Synthetic oligonucleotide
gcgcttcgacagcgacggggg

SEQ ID NO: 416784 - DNA, 21 bp, Artificial Sequence
  Description of Artificial Sequence: Synthetic oligonucleotide
cgcttcgacagcgacgggggg

SEQ ID NO: 416785 - DNA, 22 bp, Artificial Sequence
  Description of Artificial Sequence: Synthetic oligonucleotide
gcttcgacagcgacggggggga

SEQ ID NO: 416786 - DNA, 24 bp, Artificial Sequence
  Description of Artificial Sequence: Synthetic oligonucleotide
cttcgacagcgacgggggggagta

SEQ ID NO: 416787 - DNA, 24 bp, Artificial Sequence
  Description of Artificial Sequence: Synthetic oligonucleotide
ttcgacagcgacgggggggagtac

SEQ ID NO: 416788 - DNA, 23 bp, Artificial Sequence
  Description of Artificial Sequence: Synthetic oligonucleotide
tcgacagcgacgggggggagtac

SEQ ID NO: 416789 - DNA, 22 bp, Artificial Sequence
  Description of Artificial Sequence: Synthetic oligonucleotide
cgacagcgacgggggggagtac

SEQ ID NO: 416790 - DNA, 22 bp, Artificial Sequence
  Description of Artificial Sequence: Synthetic oligonucleotide
gacagcgacgggggggagtacc

SEQ ID NO: 416791 - DNA, 22 bp, Artificial Sequence
  Description of Artificial Sequence: Synthetic oligonucleotide
acagcgacgggggggagtaccg

SEQ ID NO: 416792 - DNA, 21 bp, Artificial Sequence
  Description of Artificial Sequence: Synthetic oligonucleotide
cagcgacgggggggagtaccg

SEQ ID NO: 416793 - DNA, 21 bp, Artificial Sequence
  Description of Artificial Sequence: Synthetic oligonucleotide
agcgacgggggggagtaccgg

SEQ ID NO: 416794 - DNA, 20 bp, Artificial Sequence
  Description of Artificial Sequence: Synthetic oligonucleotide
gcgacgggggggagtaccgg

SEQ ID NO: 416795 - DNA, 20 bp, Artificial Sequence
  Description of Artificial Sequence: Synthetic oligonucleotide
cgacgggggggagtaccggg

SEQ ID NO: 416796 - DNA, 20 bp, Artificial Sequence
  Description of Artificial Sequence: Synthetic oligonucleotide
gacgggggggagtaccgggc

SEQ ID NO: 416797 - DNA, 20 bp, Artificial Sequence
  Description of Artificial Sequence: Synthetic oligonucleotide
acgggggggagtaccgggcg

SEQ ID NO: 416798 - DNA, 20 bp, Artificial Sequence
  Description of Artificial Sequence: Synthetic oligonucleotide
cgggggggagtaccgggcgt

SEQ ID NO: 416799 - DNA, 20 bp, Artificial Sequence
  Description of Artificial Sequence: Synthetic oligonucleotide
gggggggagtaccgggcggt

SEQ ID NO: 416800 - DNA, 21 bp, Artificial Sequence
  Description of Artificial Sequence: Synthetic oligonucleotide
ggggggagtaccgggcggtga

SEQ ID NO: 416801 - DNA, 41 bp, Artificial Sequence
  Description of Artificial Sequence: Synthetic oligonucleotide
cacgtttcttgaagcaggataactttgagtgtcatttcttc

SEQ ID NO: 416802 - DNA, 43 bp, Artificial Sequence
  Description of Artificial Sequence: Synthetic oligonucleotide
acgtttcttgaagcaggataactttgagtgtcatttcttcaac

SEQ ID NO: 416803 - DNA, 42 bp, Artificial Sequence
  Description of Artificial Sequence: Synthetic oligonucleotide
cgtttcttgaagcaggataactttgagtgtcatttcttcaac

SEQ ID NO: 416804 - DNA, 42 bp, Artificial Sequence
  Description of Artificial Sequence: Synthetic oligonucleotide
gtttcttgaagcaggataactttgagtgtcatttcttcaacg

SEQ ID NO: 416805 - DNA, 42 bp, Artificial Sequence
  Description of Artificial Sequence: Synthetic oligonucleotide
tttcttgaagcaggataactttgagtgtcatttcttcaacgg

SEQ ID NO: 416806 - DNA, 41 bp, Artificial Sequence
  Description of Artificial Sequence: Synthetic oligonucleotide
ttcttgaagcaggataactttgagtgtcatttcttcaacgg

SEQ ID NO: 416807 - DNA, 40 bp, Artificial Sequence
  Description of Artificial Sequence: Synthetic oligonucleotide
tcttgaagcaggataactttgagtgtcatttcttcaacgg

SEQ ID NO: 416808 - DNA, 39 bp, Artificial Sequence
  Description of Artificial Sequence: Synthetic oligonucleotide
cttgaagcaggataactttgagtgtcatttcttcaacgg

SEQ ID NO: 416809 - DNA, 39 bp, Artificial Sequence
  Description of Artificial Sequence: Synthetic oligonucleotide
ttgaagcaggataactttgagtgtcatttcttcaacggg

SEQ ID NO: 416810 - DNA, 38 bp, Artificial Sequence
  Description of Artificial Sequence: Synthetic oligonucleotide
tgaagcaggataactttgagtgtcatttcttcaacggg

SEQ ID NO: 416811 - DNA, 37 bp, Artificial Sequence
  Description of Artificial Sequence: Synthetic oligonucleotide
gaagcaggataactttgagtgtcatttcttcaacggg

SEQ ID NO: 416812 - DNA, 38 bp, Artificial Sequence
  Description of Artificial Sequence: Synthetic oligonucleotide
aagcaggataactttgagtgtcatttcttcaacgggac

SEQ ID NO: 416813 - DNA, 37 bp, Artificial Sequence
  Description of Artificial Sequence: Synthetic oligonucleotide
agcaggataactttgagtgtcatttcttcaacgggac

SEQ ID NO: 416814 - DNA, 36 bp, Artificial Sequence
  Description of Artificial Sequence: Synthetic oligonucleotide
gcaggataactttgagtgtcatttcttcaacgggac

SEQ ID NO: 416815 - DNA, 36 bp, Artificial Sequence
  Description of Artificial Sequence: Synthetic oligonucleotide
caggataactttgagtgtcatttcttcaacgggacg

SEQ ID NO: 416816 - DNA, 36 bp, Artificial Sequence
  Description of Artificial Sequence: Synthetic oligonucleotide
aggataactttgagtgtcatttcttcaacgggacgg

SEQ ID NO: 416817 - DNA, 35 bp, Artificial Sequence
  Description of Artificial Sequence: Synthetic oligonucleotide
ggataactttgagtgtcatttcttcaacgggacgg

SEQ ID NO: 416818 - DNA, 36 bp, Artificial Sequence
  Description of Artificial Sequence: Synthetic oligonucleotide
gataactttgagtgtcatttcttcaacgggacggag

SEQ ID NO: 416819 - DNA, 36 bp, Artificial Sequence
  Description of Artificial Sequence: Synthetic oligonucleotide
ataactttgagtgtcatttcttcaacgggacggagc

SEQ ID NO: 416820 - DNA, 35 bp, Artificial Sequence
  Description of Artificial Sequence: Synthetic oligonucleotide
taactttgagtgtcatttcttcaacgggacggagc

SEQ ID NO: 416821 - DNA, 34 bp, Artificial Sequence
  Description of Artificial Sequence: Synthetic oligonucleotide
aactttgagtgtcatttcttcaacgggacggagc

SEQ ID NO: 416822 - DNA, 33 bp, Artificial Sequence
  Description of Artificial Sequence: Synthetic oligonucleotide
actttgagtgtcatttcttcaacgggacggagc

SEQ ID NO: 416823 - DNA, 32 bp, Artificial Sequence
  Description of Artificial Sequence: Synthetic oligonucleotide
ctttgagtgtcatttcttcaacgggacggagc

SEQ ID NO: 416824 - DNA, 33 bp, Artificial Sequence
  Description of Artificial Sequence: Synthetic oligonucleotide
agaggcatctataaccaagaggagaacgtgctc

SEQ ID NO: 416825 - DNA, 32 bp, Artificial Sequence
  Description of Artificial Sequence: Synthetic oligonucleotide
gaggcatctataaccaagaggagaacgtgctc

SEQ ID NO: 416826 - DNA, 34 bp, Artificial Sequence
  Description of Artificial Sequence: Synthetic oligonucleotide
aggcatctataaccaagaggagaacgtgctcttc

SEQ ID NO: 416827 - DNA, 33 bp, Artificial Sequence
  Description of Artificial Sequence: Synthetic oligonucleotide
ggcatctataaccaagaggagaacgtgctcttc

SEQ ID NO: 416828 - DNA, 33 bp, Artificial Sequence
  Description of Artificial Sequence: Synthetic oligonucleotide
gcatctataaccaagaggagaacgtgctcttcg

SEQ ID NO: 416829 - DNA, 34 bp, Artificial Sequence
  Description of Artificial Sequence: Synthetic oligonucleotide
catctataaccaagaggagaacgtgctcttcgac

SEQ ID NO: 416830 - DNA, 35 bp, Artificial Sequence
  Description of Artificial Sequence: Synthetic oligonucleotide
atctataaccaagaggagaacgtgctcttcgacag

SEQ ID NO: 416831 - DNA, 34 bp, Artificial Sequence
  Description of Artificial Sequence: Synthetic oligonucleotide
tctataaccaagaggagaacgtgctcttcgacag

SEQ ID NO: 416832 - DNA, 33 bp, Artificial Sequence
  Description of Artificial Sequence: Synthetic oligonucleotide
ctataaccaagaggagaacgtgctcttcgacag

SEQ ID NO: 416833 - DNA, 33 bp, Artificial Sequence
  Description of Artificial Sequence: Synthetic oligonucleotide
tataaccaagaggagaacgtgctcttcgacagc

SEQ ID NO: 416834 - DNA, 32 bp, Artificial Sequence
  Description of Artificial Sequence: Synthetic oligonucleotide
ataaccaagaggagaacgtgctcttcgacagc

SEQ ID NO: 416835 - DNA, 31 bp, Artificial Sequence
  Description of Artificial Sequence: Synthetic oligonucleotide
taaccaagaggagaacgtgctcttcgacagc

SEQ ID NO: 416836 - DNA, 30 bp, Artificial Sequence
  Description of Artificial Sequence: Synthetic oligonucleotide
aaccaagaggagaacgtgctcttcgacagc

SEQ ID NO: 416837 - DNA, 29 bp, Artificial Sequence
  Description of Artificial Sequence: Synthetic oligonucleotide
accaagaggagaacgtgctcttcgacagc

SEQ ID NO: 416838 - DNA, 28 bp, Artificial Sequence
  Description of Artificial Sequence: Synthetic oligonucleotide
ccaagaggagaacgtgctcttcgacagc

SEQ ID NO: 416839 - DNA, 28 bp, Artificial Sequence
  Description of Artificial Sequence: Synthetic oligonucleotide
caagaggagaacgtgctcttcgacagcg

SEQ ID NO: 416840 - DNA, 29 bp, Artificial Sequence
  Description of Artificial Sequence: Synthetic oligonucleotide
aagaggagaacgtgctcttcgacagcgac

SEQ ID NO: 416841 - DNA, 28 bp, Artificial Sequence
  Description of Artificial Sequence: Synthetic oligonucleotide
agaggagaacgtgctcttcgacagcgac

SEQ ID NO: 416842 - DNA, 27 bp, Artificial Sequence
  Description of Artificial Sequence: Synthetic oligonucleotide
gaggagaacgtgctcttcgacagcgac

SEQ ID NO: 416843 - DNA, 27 bp, Artificial Sequence
  Description of Artificial Sequence: Synthetic oligonucleotide
aggagaacgtgctcttcgacagcgacg

SEQ ID NO: 416844 - DNA, 27 bp, Artificial Sequence
  Description of Artificial Sequence: Synthetic oligonucleotide
ggagaacgtgctcttcgacagcgacgt

SEQ ID NO: 416845 - DNA, 27 bp, Artificial Sequence
  Description of Artificial Sequence: Synthetic oligonucleotide
gagaacgtgctcttcgacagcgacgtg

SEQ ID NO: 416846 - DNA, 27 bp, Artificial Sequence
  Description of Artificial Sequence: Synthetic oligonucleotide
agaacgtgctcttcgacagcgacgtgg

SEQ ID NO: 416847 - DNA, 26 bp, Artificial Sequence
  Description of Artificial Sequence: Synthetic oligonucleotide
gaacgtgctcttcgacagcgacgtgg

SEQ ID NO: 416848 - DNA, 26 bp, Artificial Sequence
  Description of Artificial Sequence: Synthetic oligonucleotide
aacgtgctcttcgacagcgacgtggg

SEQ ID NO: 416849 - DNA, 25 bp, Artificial Sequence
  Description of Artificial Sequence: Synthetic oligonucleotide
acgtgctcttcgacagcgacgtggg

SEQ ID NO: 416850 - DNA, 24 bp, Artificial Sequence
  Description of Artificial Sequence: Synthetic oligonucleotide
cgtgctcttcgacagcgacgtggg

SEQ ID NO: 416851 - DNA, 24 bp, Artificial Sequence
  Description of Artificial Sequence: Synthetic oligonucleotide
gtgctcttcgacagcgacgtgggg

SEQ ID NO: 416852 - DNA, 25 bp, Artificial Sequence
  Description of Artificial Sequence: Synthetic oligonucleotide
tgctcttcgacagcgacgtggggga

SEQ ID NO: 416853 - DNA, 24 bp, Artificial Sequence
  Description of Artificial Sequence: Synthetic oligonucleotide
gctcttcgacagcgacgtggggga

SEQ ID NO: 416854 - DNA, 26 bp, Artificial Sequence
  Description of Artificial Sequence: Synthetic oligonucleotide
ctcttcgacagcgacgtgggggagta

SEQ ID NO: 416855 - DNA, 26 bp, Artificial Sequence
  Description of Artificial Sequence: Synthetic oligonucleotide
tcttcgacagcgacgtgggggagtac

SEQ ID NO: 416856 - DNA, 25 bp, Artificial Sequence
  Description of Artificial Sequence: Synthetic oligonucleotide
ttcgacagcgacgtgggggagtacg

SEQ ID NO: 416857 - DNA, 24 bp, Artificial Sequence
  Description of Artificial Sequence: Synthetic oligonucleotide
tcgacagcgacgtgggggagtacg

SEQ ID NO: 416858 - DNA, 23 bp, Artificial Sequence
  Description of Artificial Sequence: Synthetic oligonucleotide
cgacagcgacgtgggggagtacg

SEQ ID NO: 416859 - DNA, 23 bp, Artificial Sequence
  Description of Artificial Sequence: Synthetic oligonucleotide
gacagcgacgtgggggagtacgg

SEQ ID NO: 416860 - DNA, 23 bp, Artificial Sequence
  Description of Artificial Sequence: Synthetic oligonucleotide
acagcgacgtgggggagtacggg

SEQ ID NO: 416861 - DNA, 22 bp, Artificial Sequence
  Description of Artificial Sequence: Synthetic oligonucleotide
cagcgacgtgggggagtacggg

SEQ ID NO: 416862 - DNA, 22 bp, Artificial Sequence
  Description of Artificial Sequence: Synthetic oligonucleotide
agcgacgtgggggagtacgggg

SEQ ID NO: 416863 - DNA, 21 bp, Artificial Sequence
  Description of Artificial Sequence: Synthetic oligonucleotide
gcgacgtgggggagtacgggg

SEQ ID NO: 416864 - DNA, 21 bp, Artificial Sequence
  Description of Artificial Sequence: Synthetic oligonucleotide
cgacgtgggggagtacggggc

SEQ ID NO: 416865 - DNA, 21 bp, Artificial Sequence
  Description of Artificial Sequence: Synthetic oligonucleotide
gacgtgggggagtacggggcg

SEQ ID NO: 416866 - DNA, 22 bp, Artificial Sequence
  Description of Artificial Sequence: Synthetic oligonucleotide
acgtgggggagtacggggcggt

SEQ ID NO: 416867 - DNA, 21 bp, Artificial Sequence
  Description of Artificial Sequence: Synthetic oligonucleotide
cgtgggggagtacggggcggt

SEQ ID NO: 416868 - DNA, 22 bp, Artificial Sequence
  Description of Artificial Sequence: Synthetic oligonucleotide
gtgggggagtacggggcggtga

SEQ ID NO: 416869 - DNA, 22 bp, Artificial Sequence
  Description of Artificial Sequence: Synthetic oligonucleotide
tgggggagtacggggcggtgac

SEQ ID NO: 416870 - DNA, 21 bp, Artificial Sequence
  Description of Artificial Sequence: Synthetic oligonucleotide
gggggagtacggggcggtgac

SEQ ID NO: 416871 - DNA, 21 bp, Artificial Sequence
  Description of Artificial Sequence: Synthetic oligonucleotide
ggggagtacggggcggtgacg

SEQ ID NO: 416872 - DNA, 22 bp, Artificial Sequence
  Description of Artificial Sequence: Synthetic oligonucleotide
gggagtacggggcggtgacgga

SEQ ID NO: 416873 - DNA, 22 bp, Artificial Sequence
  Description of Artificial Sequence: Synthetic oligonucleotide
ggagtacggggcggtgacggag

SEQ ID NO: 416874 - DNA, 23 bp, Artificial Sequence
  Description of Artificial Sequence: Synthetic oligonucleotide
gagtacggggcggtgacggagct

SEQ ID NO: 416875 - DNA, 23 bp, Artificial Sequence
  Description of Artificial Sequence: Synthetic oligonucleotide
agtacggggcggtgacggagctg

SEQ ID NO: 416876 - DNA, 22 bp, Artificial Sequence
  Description of Artificial Sequence: Synthetic oligonucleotide
gtacggggcggtgacggagctg

SEQ ID NO: 416877 - DNA, 22 bp, Artificial Sequence
  Description of Artificial Sequence: Synthetic oligonucleotide
tacggggcggtgacggagctgg

SEQ ID NO: 416878 - DNA, 21 bp, Artificial Sequence
  Description of Artificial Sequence: Synthetic oligonucleotide
acggggcggtgacggagctgg

SEQ ID NO: 416879 - DNA, 20 bp, Artificial Sequence
  Description of Artificial Sequence: Synthetic oligonucleotide
cggggcggtgacggagctgg

SEQ ID NO: 416880 - DNA, 20 bp, Artificial Sequence
  Description of Artificial Sequence: Synthetic oligonucleotide
ggggcggtgacggagctggg

SEQ ID NO: 416881 - DNA, 20 bp, Artificial Sequence
  Description of Artificial Sequence: Synthetic oligonucleotide
agcggaggcgggccgagggt

SEQ ID NO: 416882 - DNA, 20 bp, Artificial Sequence
  Description of Artificial Sequence: Synthetic oligonucleotide
gcggaggcgggccgagggtt

SEQ ID NO: 416883 - DNA, 20 bp, Artificial Sequence
  Description of Artificial Sequence: Synthetic oligonucleotide
cggaggcgggccgaggggtt

SEQ ID NO: 416884 - DNA, 20 bp, Artificial Sequence
  Description of Artificial Sequence: Synthetic oligonucleotide
ggaggcgggccgagggggat

SEQ ID NO: 416885 - DNA, 20 bp, Artificial Sequence
  Description of Artificial Sequence: Synthetic oligonucleotide
gaggcgggccgagggggaca

SEQ ID NO: 416886 - DNA, 20 bp, Artificial Sequence
  Description of Artificial Sequence: Synthetic oligonucleotide
aggcgggccgagggggacac

SEQ ID NO: 416887 - DNA, 20 bp, Artificial Sequence
  Description of Artificial Sequence: Synthetic oligonucleotide
ggcgggccgagggggacact

SEQ ID NO: 416888 - DNA, 20 bp, Artificial Sequence
  Description of Artificial Sequence: Synthetic oligonucleotide
gcgggccgagggggacacct

SEQ ID NO: 416889 - DNA, 20 bp, Artificial Sequence
  Description of Artificial Sequence: Synthetic oligonucleotide
cgggccgagggggacaccgt

SEQ ID NO: 416890 - DNA, 21 bp, Artificial Sequence
  Description of Artificial Sequence: Synthetic oligonucleotide
gggccgagggggacaccgtgt

SEQ ID NO: 416891 - DNA, 21 bp, Artificial Sequence
  Description of Artificial Sequence: Synthetic oligonucleotide
ggccgagggggacaccgtgtg

SEQ ID NO: 416892 - DNA, 22 bp, Artificial Sequence
  Description of Artificial Sequence: Synthetic oligonucleotide
gccgagggggacaccgtgtgca

SEQ ID NO: 416893 - DNA, 23 bp, Artificial Sequence
  Description of Artificial Sequence: Synthetic oligonucleotide
ccgagggggacaccgtgtgcaga

SEQ ID NO: 416894 - DNA, 24 bp, Artificial Sequence
  Description of Artificial Sequence: Synthetic oligonucleotide
cgagggggacaccgtgtgcagaca

SEQ ID NO: 416895 - DNA, 26 bp, Artificial Sequence
  Description of Artificial Sequence: Synthetic oligonucleotide
gagggggacaccgtgtgcagacacaa

SEQ ID NO: 416896 - DNA, 27 bp, Artificial Sequence
  Description of Artificial Sequence: Synthetic oligonucleotide
agggggacaccgtgtgcagacacaact

SEQ ID NO: 416897 - DNA, 27 bp, Artificial Sequence
  Description of Artificial Sequence: Synthetic oligonucleotide
gggggacaccgtgtgcagacacaacta

SEQ ID NO: 416898 - DNA, 27 bp, Artificial Sequence
  Description of Artificial Sequence: Synthetic oligonucleotide
ggggacaccgtgtgcagacacaactac

SEQ ID NO: 416899 - DNA, 27 bp, Artificial Sequence
  Description of Artificial Sequence: Synthetic oligonucleotide
gggacaccgtgtgcagacacaactacg

SEQ ID NO: 416900 - DNA, 21 bp, Artificial Sequence
  Description of Artificial Sequence: Synthetic oligonucleotide
gcgggccgaggtggacaccct

SEQ ID NO: 416901 - DNA, 22 bp, Artificial Sequence
  Description of Artificial Sequence: Synthetic oligonucleotide
cgggccgaggtggacaccctgt

SEQ ID NO: 416902 - DNA, 22 bp, Artificial Sequence
  Description of Artificial Sequence: Synthetic oligonucleotide
gggccgaggtggacaccctgtg

SEQ ID NO: 416903 - DNA, 23 bp, Artificial Sequence
  Description of Artificial Sequence: Synthetic oligonucleotide
ggccgaggtggacaccctgtgca

SEQ ID NO: 416904 - DNA, 24 bp, Artificial Sequence
  Description of Artificial Sequence: Synthetic oligonucleotide
gccgaggtggacaccctgtgcaga

SEQ ID NO: 416905 - DNA, 25 bp, Artificial Sequence
  Description of Artificial Sequence: Synthetic oligonucleotide
ccgaggtggacaccctgtgcagaca

SEQ ID NO: 416906 - DNA, 27 bp, Artificial Sequence
  Description of Artificial Sequence: Synthetic oligonucleotide
cgaggtggacaccctgtgcagacacaa

SEQ ID NO: 416907 - DNA, 27 bp, Artificial Sequence
  Description of Artificial Sequence: Synthetic oligonucleotide
gaggtggacaccctgtgcagacacaac

SEQ ID NO: 416908 - DNA, 29 bp, Artificial Sequence
  Description of Artificial Sequence: Synthetic oligonucleotide
aggtggacaccctgtgcagacacaactac

SEQ ID NO: 416909 - DNA, 28 bp, Artificial Sequence
  Description of Artificial Sequence: Synthetic oligonucleotide
ggtggacaccctgtgcagacacaactac

SEQ ID NO: 416910 - DNA, 28 bp, Artificial Sequence
  Description of Artificial Sequence: Synthetic oligonucleotide
gtggacaccctgtgcagacacaactacg

SEQ ID NO: 416911 - DNA, 28 bp, Artificial Sequence
  Description of Artificial Sequence: Synthetic oligonucleotide
tggacaccctgtgcagacacaactacgg

SEQ ID NO: 416912 - DNA, 27 bp, Artificial Sequence
  Description of Artificial Sequence: Synthetic oligonucleotide
ggacaccctgtgcagacacaactacgg

SEQ ID NO: 416913 - DNA, 27 bp, Artificial Sequence
  Description of Artificial Sequence: Synthetic oligonucleotide
gacaccctgtgcagacacaactacggg

SEQ ID NO: 416914 - DNA, 27 bp, Artificial Sequence
  Description of Artificial Sequence: Synthetic oligonucleotide
acaccctgtgcagacacaactacgggg

SEQ ID NO: 416915 - DNA, 27 bp, Artificial Sequence
  Description of Artificial Sequence: Synthetic oligonucleotide
caccctgtgcagacacaactacggggt

SEQ ID NO: 416916 - DNA, 28 bp, Artificial Sequence
  Description of Artificial Sequence: Synthetic oligonucleotide
accctgtgcagacacaactacggggttg

SEQ ID NO: 416917 - DNA, 27 bp, Artificial Sequence
  Description of Artificial Sequence: Synthetic oligonucleotide
ccctgtgcagacacaactacggggttg

SEQ ID NO: 416918 - DNA, 27 bp, Artificial Sequence
  Description of Artificial Sequence: Synthetic oligonucleotide
cctgtgcagacacaactacggggttgg

SEQ ID NO: 416919 - DNA, 28 bp, Artificial Sequence
  Description of Artificial Sequence: Synthetic oligonucleotide
ctgtgcagacacaactacggggttggtg

SEQ ID NO: 416920 - DNA, 27 bp, Artificial Sequence
  Description of Artificial Sequence: Synthetic oligonucleotide
gggacaccagaccacgtttcttggagg

SEQ ID NO: 416921 - DNA, 28 bp, Artificial Sequence
  Description of Artificial Sequence: Synthetic oligonucleotide
ggacaccagaccacgtttcttggaggag

SEQ ID NO: 416922 - DNA, 28 bp, Artificial Sequence
  Description of Artificial Sequence: Synthetic oligonucleotide
gacaccagaccacgtttcttggaggagg

SEQ ID NO: 416923 - DNA, 32 bp, Artificial Sequence; identical to SEQ ID NO: 69741
  Description of Artificial Sequence: Synthetic oligonucleotide

SEQ ID NO: 416924 - DNA, 31 bp, Artificial Sequence; identical to SEQ ID NO: 69742
  Description of Artificial Sequence: Synthetic oligonucleotide

SEQ ID NO: 416925 - DNA, 34 bp, Artificial Sequence; identical to SEQ ID NO: 69743
  Description of Artificial Sequence: Synthetic oligonucleotide

SEQ ID NO: 416926 - DNA, 33 bp, Artificial Sequence; identical to SEQ ID NO: 69744
  Description of Artificial Sequence: Synthetic oligonucleotide

SEQ ID NO: 416927 - DNA, 34 bp, Artificial Sequence; identical to SEQ ID NO: 69745
  Description of Artificial Sequence: Synthetic oligonucleotide

SEQ ID NO: 416928 - DNA, 35 bp, Artificial Sequence; identical to SEQ ID NO: 69746
  Description of Artificial Sequence: Synthetic oligonucleotide

SEQ ID NO: 416929 - DNA, 34 bp, Artificial Sequence; identical to SEQ ID NO: 69747
  Description of Artificial Sequence: Synthetic oligonucleotide

SEQ ID NO: 416930 - DNA, 35 bp, Artificial Sequence; identical to SEQ ID NO: 69748
  Description of Artificial Sequence: Synthetic oligonucleotide

SEQ ID NO: 416931 - DNA, 34 bp, Artificial Sequence; identical to SEQ ID NO: 69749
  Description of Artificial Sequence: Synthetic oligonucleotide

SEQ ID NO: 416932 - DNA, 38 bp, Artificial Sequence; identical to SEQ ID NO: 69750
  Description of Artificial Sequence: Synthetic oligonucleotide

SEQ ID NO: 416933 - DNA, 40 bp, Artificial Sequence; identical to SEQ ID NO: 69751
  Description of Artificial Sequence: Synthetic oligonucleotide

SEQ ID NO: 416934 - DNA, 39 bp, Artificial Sequence; identical to SEQ ID NO: 69752
  Description of Artificial Sequence: Synthetic oligonucleotide

SEQ ID NO: 416935 - DNA, 41 bp, Artificial Sequence; identical to SEQ ID NO: 69753
  Description of Artificial Sequence: Synthetic oligonucleotide

SEQ ID NO: 416936 - DNA, 41 bp, Artificial Sequence; identical to SEQ ID NO: 69754
  Description of Artificial Sequence: Synthetic oligonucleotide

SEQ ID NO: 416937 - DNA, 40 bp, Artificial Sequence; identical to SEQ ID NO: 69755
  Description of Artificial Sequence: Synthetic oligonucleotide

SEQ ID NO: 416938 - DNA, 39 bp, Artificial Sequence; identical to SEQ ID NO: 69756
  Description of Artificial Sequence: Synthetic oligonucleotide

SEQ ID NO: 416939 - DNA, 38 bp, Artificial Sequence; identical to SEQ ID NO: 69757
  Description of Artificial Sequence: Synthetic oligonucleotide

SEQ ID NO: 416940 - DNA, 38 bp, Artificial Sequence; identical to SEQ ID NO: 69758
  Description of Artificial Sequence: Synthetic oligonucleotide

SEQ ID NO: 416941 - DNA, 37 bp, Artificial Sequence; identical to SEQ ID NO: 69759
  Description of Artificial Sequence: Synthetic oligonucleotide

SEQ ID NO: 416942 - DNA, 36 bp, Artificial Sequence; identical to SEQ ID NO: 69760
  Description of Artificial Sequence: Synthetic oligonucleotide

SEQ ID NO: 416943 - DNA, 36 bp, Artificial Sequence; identical to SEQ ID NO: 69761
  Description of Artificial Sequence: Synthetic oligonucleotide

SEQ ID NO: 416944 - DNA, 37 bp, Artificial Sequence; identical to SEQ ID NO: 69762
  Description of Artificial Sequence: Synthetic oligonucleotide

SEQ ID NO: 416945 - DNA, 36 bp, Artificial Sequence; identical to SEQ ID NO: 69763
  Description of Artificial Sequence: Synthetic oligonucleotide

SEQ ID NO: 416946 - DNA, 36 bp, Artificial Sequence; identical to SEQ ID NO: 69764
  Description of Artificial Sequence: Synthetic oligonucleotide

SEQ ID NO: 416947 - DNA, 36 bp, Artificial Sequence; identical to SEQ ID NO: 69765
  Description of Artificial Sequence: Synthetic oligonucleotide

SEQ ID NO: 416948 - DNA, 35 bp, Artificial Sequence; identical to SEQ ID NO: 69766
  Description of Artificial Sequence: Synthetic oligonucleotide

SEQ ID NO: 416949 - DNA, 36 bp, Artificial Sequence; identical to SEQ ID NO: 69767
  Description of Artificial Sequence: Synthetic oligonucleotide

SEQ ID NO: 416950 - DNA, 36 bp, Artificial Sequence; identical to SEQ ID NO: 69768
  Description of Artificial Sequence: Synthetic oligonucleotide

SEQ ID NO: 416951 - DNA, 25 bp, Artificial Sequence
  Description of Artificial Sequence: Synthetic oligonucleotide
ggagcgggtgcggttgctggaaaga

SEQ ID NO: 416952 - DNA, 25 bp, Artificial Sequence
  Description of Artificial Sequence: Synthetic oligonucleotide
gagcgggtgcggttgctggaaagac

SEQ ID NO: 416953 - DNA, 25 bp, Artificial Sequence
  Description of Artificial Sequence: Synthetic oligonucleotide
agcgggtgcggttgctggaaagacg

SEQ ID NO: 416954 - DNA, 24 bp, Artificial Sequence
  Description of Artificial Sequence: Synthetic oligonucleotide
gcgggtgcggttgctggaaagacg

SEQ ID NO: 416955 - DNA, 24 bp, Artificial Sequence
  Description of Artificial Sequence: Synthetic oligonucleotide
cgggtgcggttgctggaaagacgc

SEQ ID NO: 416956 - DNA, 25 bp, Artificial Sequence
  Description of Artificial Sequence: Synthetic oligonucleotide
gggtgcggttgctggaaagacgcgt

SEQ ID NO: 416957 - DNA, 25 bp, Artificial Sequence
  Description of Artificial Sequence: Synthetic oligonucleotide
ggtgcggttgctggaaagacgcgtc

SEQ ID NO: 416958 - DNA, 27 bp, Artificial Sequence
  Description of Artificial Sequence: Synthetic oligonucleotide
gtgcggttgctggaaagacgcgtccat

SEQ ID NO: 416959 - DNA, 29 bp, Artificial Sequence
  Description of Artificial Sequence: Synthetic oligonucleotide
tgcggttgctggaaagacgcgtccataac

SEQ ID NO: 416960 - DNA, 28 bp, Artificial Sequence
  Description of Artificial Sequence: Synthetic oligonucleotide
gcggttgctggaaagacgcgtccataac

SEQ ID NO: 416961 - DNA, 28 bp, Artificial Sequence
  Description of Artificial Sequence: Synthetic oligonucleotide
cggttgctggaaagacgcgtccataacc

SEQ ID NO: 416962 - DNA, 30 bp, Artificial Sequence; identical to SEQ ID NO: 69780
  Description of Artificial Sequence: Synthetic oligonucleotide

SEQ ID NO: 416963 - DNA, 31 bp, Artificial Sequence; identical to SEQ ID NO: 69781
  Description of Artificial Sequence: Synthetic oligonucleotide

SEQ ID NO: 416964 - DNA, 31 bp, Artificial Sequence; identical to SEQ ID NO: 69782
  Description of Artificial Sequence: Synthetic oligonucleotide

SEQ ID NO: 416965 - DNA, 30 bp, Artificial Sequence; identical to SEQ ID NO: 69783
  Description of Artificial Sequence: Synthetic oligonucleotide

SEQ ID NO: 416966 - DNA, 29 bp, Artificial Sequence
  Description of Artificial Sequence: Synthetic oligonucleotide
gctggaaagacgcgtccataaccaagagg

SEQ ID NO: 416967 - DNA, 30 bp, Artificial Sequence; identical to SEQ ID NO: 69785
  Description of Artificial Sequence: Synthetic oligonucleotide

SEQ ID NO: 416968 - DNA, 32 bp, Artificial Sequence; identical to SEQ ID NO: 69786
  Description of Artificial Sequence: Synthetic oligonucleotide

SEQ ID NO: 416969 - DNA, 31 bp, Artificial Sequence; identical to SEQ ID NO: 69787
  Description of Artificial Sequence: Synthetic oligonucleotide

SEQ ID NO: 416970 - DNA, 31 bp, Artificial Sequence; identical to SEQ ID NO: 69788
  Description of Artificial Sequence: Synthetic oligonucleotide

SEQ ID NO: 416971 - DNA, 31 bp, Artificial Sequence; identical to SEQ ID NO: 69789
  Description of Artificial Sequence: Synthetic oligonucleotide

SEQ ID NO: 416972 - DNA, 30 bp, Artificial Sequence; identical to SEQ ID NO: 69790
  Description of Artificial Sequence: Synthetic oligonucleotide

SEQ ID NO: 416973 - DNA, 29 bp, Artificial Sequence
  Description of Artificial Sequence: Synthetic oligonucleotide
agacgcgtccataaccaagaggagtacgc

SEQ ID NO: 416974 - DNA, 28 bp, Artificial Sequence
  Description of Artificial Sequence: Synthetic oligonucleotide
gacgcgtccataaccaagaggagtacgc

SEQ ID NO: 416975 - DNA, 28 bp, Artificial Sequence
  Description of Artificial Sequence: Synthetic oligonucleotide
acgcgtccataaccaagaggagtacgcg

SEQ ID NO: 416976 - DNA, 27 bp, Artificial Sequence
  Description of Artificial Sequence: Synthetic oligonucleotide
cgcgtccataaccaagaggagtacgcg

SEQ ID NO: 416977 - DNA, 27 bp, Artificial Sequence
  Description of Artificial Sequence: Synthetic oligonucleotide
gcgtccataaccaagaggagtacgcgc

SEQ ID NO: 416978 - DNA, 27 bp, Artificial Sequence
  Description of Artificial Sequence: Synthetic oligonucleotide
cgtccataaccaagaggagtacgcgcg

SEQ ID NO: 416979 - DNA, 27 bp, Artificial Sequence
  Description of Artificial Sequence: Synthetic oligonucleotide
gtccataaccaagaggagtacgcgcgc

SEQ ID NO: 416980 - DNA, 29 bp, Artificial Sequence
  Description of Artificial Sequence: Synthetic oligonucleotide
tccataaccaagaggagtacgcgcgctac

SEQ ID NO: 416981 - DNA, 28 bp, Artificial Sequence
  Description of Artificial Sequence: Synthetic oligonucleotide
ccataaccaagaggagtacgcgcgctac

SEQ ID NO: 416982 - DNA, 28 bp, Artificial Sequence
  Description of Artificial Sequence: Synthetic oligonucleotide
cataaccaagaggagtacgcgcgctacg

SEQ ID NO: 416983 - DNA, 29 bp, Artificial Sequence
  Description of Artificial Sequence: Synthetic oligonucleotide
ataaccaagaggagtacgcgcgctacgac

SEQ ID NO: 416984 - DNA, 28 bp, Artificial Sequence
  Description of Artificial Sequence: Synthetic oligonucleotide
taaccaagaggagtacgcgcgctacgac

SEQ ID NO: 416985 - DNA, 27 bp, Artificial Sequence
  Description of Artificial Sequence: Synthetic oligonucleotide
aaccaagaggagtacgcgcgctacgac

SEQ ID NO: 416986 - DNA, 27 bp, Artificial Sequence
  Description of Artificial Sequence: Synthetic oligonucleotide
accaagaggagtacgcgcgctacgaca

SEQ ID NO: 416987 - DNA, 26 bp, Artificial Sequence
  Description of Artificial Sequence: Synthetic oligonucleotide
ccaagaggagtacgcgcgctacgaca

SEQ ID NO: 416988 - DNA, 26 bp, Artificial Sequence
  Description of Artificial Sequence: Synthetic oligonucleotide
caagaggagtacgcgcgctacgacag

SEQ ID NO: 416989 - DNA, 26 bp, Artificial Sequence
  Description of Artificial Sequence: Synthetic oligonucleotide
aagaggagtacgcgcgctacgacagc

SEQ ID NO: 416990 - DNA, 25 bp, Artificial Sequence
  Description of Artificial Sequence: Synthetic oligonucleotide
agaggagtacgcgcgctacgacagc

SEQ ID NO: 416991 - DNA, 24 bp, Artificial Sequence
  Description of Artificial Sequence: Synthetic oligonucleotide
gaggagtacgcgcgctacgacagc

SEQ ID NO: 416992 - DNA, 25 bp, Artificial Sequence
  Description of Artificial Sequence: Synthetic oligonucleotide
aggagtacgcgcgctacgacagcga

SEQ ID NO: 416993 - DNA, 24 bp, Artificial Sequence
  Description of Artificial Sequence: Synthetic oligonucleotide
ggagtacgcgcgctacgacagcga

SEQ ID NO: 416994 - DNA, 24 bp, Artificial Sequence
  Description of Artificial Sequence: Synthetic oligonucleotide
gagtacgcgcgctacgacagcgac

SEQ ID NO: 416995 - DNA, 25 bp, Artificial Sequence
  Description of Artificial Sequence: Synthetic oligonucleotide
agtacgcgcgctacgacagcgacgt

SEQ ID NO: 416996 - DNA, 24 bp, Artificial Sequence
  Description of Artificial Sequence: Synthetic oligonucleotide
gtacgcgcgctacgacagcgacgt

SEQ ID NO: 416997 - DNA, 24 bp, Artificial Sequence
  Description of Artificial Sequence: Synthetic oligonucleotide
tacgcgcgctacgacagcgacgtg

SEQ ID NO: 416998 - DNA, 23 bp, Artificial Sequence
  Description of Artificial Sequence: Synthetic oligonucleotide
acgcgcgctacgacagcgacgtg

SEQ ID NO: 416999 - DNA, 22 bp, Artificial Sequence
  Description of Artificial Sequence: Synthetic oligonucleotide
cgcgcgctacgacagcgacgtg

SEQ ID NO: 417000 - DNA, 22 bp, Artificial Sequence
  Description of Artificial Sequence: Synthetic oligonucleotide
gcgcgctacgacagcgacgtgg

SEQ ID NO: 417001 - DNA, 22 bp, Artificial Sequence
  Description of Artificial Sequence: Synthetic oligonucleotide
cgcgctacgacagcgacgtggg

SEQ ID NO: 417002 - DNA, 22 bp, Artificial Sequence
  Description of Artificial Sequence: Synthetic oligonucleotide
gcgctacgacagcgacgtgggg

SEQ ID NO: 417003 - DNA, 23 bp, Artificial Sequence
  Description of Artificial Sequence: Synthetic oligonucleotide
cgctacgacagcgacgtggggga

SEQ ID NO: 417004 - DNA, 25 bp, Artificial Sequence
  Description of Artificial Sequence: Synthetic oligonucleotide
gctacgacagcgacgtgggggagta

SEQ ID NO: 417005 - DNA, 25 bp, Artificial Sequence
  Description of Artificial Sequence: Synthetic oligonucleotide
ctacgacagcgacgtgggggagtac

SEQ ID NO: 417006 - DNA, 25 bp, Artificial Sequence
  Description of Artificial Sequence: Synthetic oligonucleotide
tacgacagcgacgtgggggagtacc

SEQ ID NO: 417007 - DNA, 24 bp, Artificial Sequence
  Description of Artificial Sequence: Synthetic oligonucleotide
acgacagcgacgtgggggagtacc

SEQ ID NO: 417008 - DNA, 24 bp, Artificial Sequence
  Description of Artificial Sequence: Synthetic oligonucleotide
aaggacctcctggagcggaggcgt

SEQ ID NO: 417009 - DNA, 23 bp, Artificial Sequence
  Description of Artificial Sequence: Synthetic oligonucleotide
aggacctcctggagcggaggcgt

SEQ ID NO: 417010 - DNA, 22 bp, Artificial Sequence
  Description of Artificial Sequence: Synthetic oligonucleotide
ggacctcctggagcggaggcgt

SEQ ID NO: 417011 - DNA, 22 bp, Artificial Sequence
  Description of Artificial Sequence: Synthetic oligonucleotide
gacctcctggagcggaggcgtg

SEQ ID NO: 417012 - DNA, 22 bp, Artificial Sequence
  Description of Artificial Sequence: Synthetic oligonucleotide
acctcctggagcggaggcgtgc

SEQ ID NO: 417013 - DNA, 21 bp, Artificial Sequence
  Description of Artificial Sequence: Synthetic oligonucleotide
cctcctggagcggaggcgtgc

SEQ ID NO: 417014 - DNA, 21 bp, Artificial Sequence
  Description of Artificial Sequence: Synthetic oligonucleotide
ctcctggagcggaggcgtgcc

SEQ ID NO: 417015 - DNA, 21 bp, Artificial Sequence
  Description of Artificial Sequence: Synthetic oligonucleotide
tcctggagcggaggcgtgccg

SEQ ID NO: 417016 - DNA, 20 bp, Artificial Sequence
  Description of Artificial Sequence: Synthetic oligonucleotide
cctggagcggaggcgtgccg

SEQ ID NO: 417017 - DNA, 20 bp, Artificial Sequence
  Description of Artificial Sequence: Synthetic oligonucleotide
ctggagcggaggcgtgccgc

SEQ ID NO: 417018 - DNA, 20 bp, Artificial Sequence
  Description of Artificial Sequence: Synthetic oligonucleotide
tggagcggaggcgtgccgcg

SEQ ID NO: 417019 - DNA, 20 bp, Artificial Sequence
  Description of Artificial Sequence: Synthetic oligonucleotide
ggagcggaggcgtgccgcgt

SEQ ID NO: 417020 - DNA, 20 bp, Artificial Sequence
  Description of Artificial Sequence: Synthetic oligonucleotide
gagcggaggcgtgccgcggt

SEQ ID NO: 417021 - DNA, 20 bp, Artificial Sequence
  Description of Artificial Sequence: Synthetic oligonucleotide
agcggaggcgtgccgcggtg

SEQ ID NO: 417022 - DNA, 20 bp, Artificial Sequence
  Description of Artificial Sequence: Synthetic oligonucleotide
gcggaggcgtgccgcggtgt

SEQ ID NO: 417023 - DNA, 20 bp, Artificial Sequence
  Description of Artificial Sequence: Synthetic oligonucleotide
cggaggcgtgccgcggtgga

SEQ ID NO: 417024 - DNA, 21 bp, Artificial Sequence
  Description of Artificial Sequence: Synthetic oligonucleotide
ggaggcgtgccgcggtggaca

SEQ ID NO: 417025 - DNA, 21 bp, Artificial Sequence
  Description of Artificial Sequence: Synthetic oligonucleotide
gaggcgtgccgcggtggacac

SEQ ID NO: 417026 - DNA, 23 bp, Artificial Sequence
  Description of Artificial Sequence: Synthetic oligonucleotide
aggcgtgccgcggtggacaccta

SEQ ID NO: 417027 - DNA, 22 bp, Artificial Sequence
  Description of Artificial Sequence: Synthetic oligonucleotide
ggcgtgccgcggtggacaccta

SEQ ID NO: 417028 - DNA, 23 bp, Artificial Sequence
  Description of Artificial Sequence: Synthetic oligonucleotide
gcgtgccgcggtggacacctact

SEQ ID NO: 417029 - DNA, 23 bp, Artificial Sequence
  Description of Artificial Sequence: Synthetic oligonucleotide
cgtgccgcggtggacacctactg

SEQ ID NO: 417030 - DNA, 24 bp, Artificial Sequence
  Description of Artificial Sequence: Synthetic oligonucleotide
gtgccgcggtggacacctactgca

SEQ ID NO: 417031 - DNA, 25 bp, Artificial Sequence
  Description of Artificial Sequence: Synthetic oligonucleotide
tgccgcggtggacacctactgcaga

SEQ ID NO: 417032 - DNA, 27 bp, Artificial Sequence
  Description of Artificial Sequence: Synthetic oligonucleotide
agagcttcacagtgcagcggcgagttc

SEQ ID NO: 417033 - DNA, 27 bp, Artificial Sequence
  Description of Artificial Sequence: Synthetic oligonucleotide
gagcttcacagtgcagcggcgagttca

SEQ ID NO: 417034 - DNA, 28 bp, Artificial Sequence
  Description of Artificial Sequence: Synthetic oligonucleotide
agcttcacagtgcagcggcgagttcaac

SEQ ID NO: 417035 - DNA, 27 bp, Artificial Sequence
  Description of Artificial Sequence: Synthetic oligonucleotide
gcttcacagtgcagcggcgagttcaac

SEQ ID NO: 417036 - DNA, 27 bp, Artificial Sequence
  Description of Artificial Sequence: Synthetic oligonucleotide
cttcacagtgcagcggcgagttcaacc

SEQ ID NO: 417037 - DNA, 30 bp, Artificial Sequence; identical to SEQ ID NO: 69855
  Description of Artificial Sequence: Synthetic oligonucleotide

SEQ ID NO: 417038 - DNA, 29 bp, Artificial Sequence
  Description of Artificial Sequence: Synthetic oligonucleotide
tcacagtgcagcggcgagttcaacctaag

SEQ ID NO: 417039 - DNA, 28 bp, Artificial Sequence
  Description of Artificial Sequence: Synthetic oligonucleotide
cacagtgcagcggcgagttcaacctaag

SEQ ID NO: 417040 - DNA, 28 bp, Artificial Sequence
  Description of Artificial Sequence: Synthetic oligonucleotide
acagtgcagcggcgagttcaacctaagg

SEQ ID NO: 417041 - DNA, 27 bp, Artificial Sequence
  Description of Artificial Sequence: Synthetic oligonucleotide
cagtgcagcggcgagttcaacctaagg

SEQ ID NO: 417042 - DNA, 28 bp, Artificial Sequence
  Description of Artificial Sequence: Synthetic oligonucleotide
agtgcagcggcgagttcaacctaaggtg

SEQ ID NO: 417043 - DNA, 27 bp, Artificial Sequence
  Description of Artificial Sequence: Synthetic oligonucleotide
gtgcagcggcgagttcaacctaaggtg

SEQ ID NO: 417044 - DNA, 28 bp, Artificial Sequence
  Description of Artificial Sequence: Synthetic oligonucleotide
tgcagcggcgagttcaacctaaggtgac

SEQ ID NO: 417045 - DNA, 27 bp, Artificial Sequence
  Description of Artificial Sequence: Synthetic oligonucleotide
gcagcggcgagttcaacctaaggtgac

SEQ ID NO: 417046 - DNA, 28 bp, Artificial Sequence
  Description of Artificial Sequence: Synthetic oligonucleotide
cagcggcgagttcaacctaaggtgactg

SEQ ID NO: 417047 - DNA, 29 bp, Artificial Sequence
  Description of Artificial Sequence: Synthetic oligonucleotide
agcggcgagttcaacctaaggtgactgtg

SEQ ID NO: 417048 - DNA, 28 bp, Artificial Sequence
  Description of Artificial Sequence: Synthetic oligonucleotide
gcggcgagttcaacctaaggtgactgtg

SEQ ID NO: 417049 - DNA, 31 bp, Artificial Sequence; identical to SEQ ID NO: 69867
  Description of Artificial Sequence: Synthetic oligonucleotide

SEQ ID NO: 417050 - DNA, 31 bp, Artificial Sequence; identical to SEQ ID NO: 69868
  Description of Artificial Sequence: Synthetic oligonucleotide

SEQ ID NO: 417051 - DNA, 33 bp, Artificial Sequence; identical to SEQ ID NO: 69869
  Description of Artificial Sequence: Synthetic oligonucleotide

SEQ ID NO: 417052 - DNA, 36 bp, Artificial Sequence; identical to SEQ ID NO: 69870
  Description of Artificial Sequence: Synthetic oligonucleotide

SEQ ID NO: 417053 - DNA, 37 bp, Artificial Sequence; identical to SEQ ID NO: 69871
  Description of Artificial Sequence: Synthetic oligonucleotide

SEQ ID NO: 417054 - DNA, 37 bp, Artificial Sequence; identical to SEQ ID NO: 69872
  Description of Artificial Sequence: Synthetic oligonucleotide

SEQ ID NO: 417055 - DNA, 36 bp, Artificial Sequence; identical to SEQ ID NO: 69873
  Description of Artificial Sequence: Synthetic oligonucleotide

SEQ ID NO: 417056 - DNA, 36 bp, Artificial Sequence; identical to SEQ ID NO: 69874
  Description of Artificial Sequence: Synthetic oligonucleotide

SEQ ID NO: 417057 - DNA, 35 bp, Artificial Sequence; identical to SEQ ID NO: 69875
  Description of Artificial Sequence: Synthetic oligonucleotide

SEQ ID NO: 417058 - DNA, 34 bp, Artificial Sequence; identical to SEQ ID NO: 69876
  Description of Artificial Sequence: Synthetic oligonucleotide

SEQ ID NO: 417059 - DNA, 35 bp, Artificial Sequence; identical to SEQ ID NO: 69877
  Description of Artificial Sequence: Synthetic oligonucleotide

SEQ ID NO: 417060 - DNA, 34 bp, Artificial Sequence; identical to SEQ ID NO: 69878
  Description of Artificial Sequence: Synthetic oligonucleotide

SEQ ID NO: 417061 - DNA, 31 bp, Artificial Sequence; identical to SEQ ID NO: 69879
  Description of Artificial Sequence: Synthetic oligonucleotide

SEQ ID NO: 417062 - DNA, 31 bp, Artificial Sequence; identical to SEQ ID NO: 69880
  Description of Artificial Sequence: Synthetic oligonucleotide

SEQ ID NO: 417063 - DNA, 30 bp, Artificial Sequence; identical to SEQ ID NO: 69881
  Description of Artificial Sequence: Synthetic oligonucleotide

SEQ ID NO: 417064 - DNA, 33 bp, Artificial Sequence; identical to SEQ ID NO: 69882
  Description of Artificial Sequence: Synthetic oligonucleotide

SEQ ID NO: 417065 - DNA, 36 bp, Artificial Sequence; identical to SEQ ID NO: 69883
  Description of Artificial Sequence: Synthetic oligonucleotide

SEQ ID NO: 417066 - DNA, 35 bp, Artificial Sequence; identical to SEQ ID NO: 69884
  Description of Artificial Sequence: Synthetic oligonucleotide

SEQ ID NO: 417067 - DNA, 35 bp, Artificial Sequence; identical to SEQ ID NO: 69885
  Description of Artificial Sequence: Synthetic oligonucleotide

SEQ ID NO: 417068 - DNA, 34 bp, Artificial Sequence; identical to SEQ ID NO: 69886
  Description of Artificial Sequence: Synthetic oligonucleotide

SEQ ID NO: 417069 - DNA, 33 bp, Artificial Sequence; identical to SEQ ID NO: 69887
  Description of Artificial Sequence: Synthetic oligonucleotide

SEQ ID NO: 417070 - DNA, 34 bp, Artificial Sequence; identical to SEQ ID NO: 69888
  Description of Artificial Sequence: Synthetic oligonucleotide

SEQ ID NO: 417071 - DNA, 34 bp, Artificial Sequence; identical to SEQ ID NO: 69889
  Description of Artificial Sequence: Synthetic oligonucleotide

SEQ ID NO: 417072 - DNA, 33 bp, Artificial Sequence; identical to SEQ ID NO: 69890
  Description of Artificial Sequence: Synthetic oligonucleotide

SEQ ID NO: 417073 - DNA, 33 bp, Artificial Sequence; identical to SEQ ID NO: 69891
  Description of Artificial Sequence: Synthetic oligonucleotide

SEQ ID NO: 417074 - DNA, 34 bp, Artificial Sequence; identical to SEQ ID NO: 69892
  Description of Artificial Sequence: Synthetic oligonucleotide

SEQ ID NO: 417075 - DNA, 33 bp, Artificial Sequence; identical to SEQ ID NO: 69893
  Description of Artificial Sequence: Synthetic oligonucleotide

SEQ ID NO: 417076 - DNA, 33 bp, Artificial Sequence; identical to SEQ ID NO: 69894
  Description of Artificial Sequence: Synthetic oligonucleotide

SEQ ID NO: 417077 - DNA, 36 bp, Artificial Sequence; identical to SEQ ID NO: 69895
  Description of Artificial Sequence: Synthetic oligonucleotide

SEQ ID NO: 417078 - DNA, 35 bp, Artificial Sequence; identical to SEQ ID NO: 69896
  Description of Artificial Sequence: Synthetic oligonucleotide

SEQ ID NO: 417079 - DNA, 37 bp, Artificial Sequence; identical to SEQ ID NO: 69897
  Description of Artificial Sequence: Synthetic oligonucleotide

SEQ ID NO: 417080 - DNA, 36 bp, Artificial Sequence; identical to SEQ ID NO: 69898
  Description of Artificial Sequence: Synthetic oligonucleotide

SEQ ID NO: 417081 - DNA, 37 bp, Artificial Sequence; identical to SEQ ID NO: 69899
  Description of Artificial Sequence: Synthetic oligonucleotide

SEQ ID NO: 417082 - DNA, 27 bp, Artificial Sequence
  Description of Artificial Sequence: Synthetic oligonucleotide
gaagagaagactggggtggtgtccacg

SEQ ID NO: 417083 - DNA, 27 bp, Artificial Sequence
  Description of Artificial Sequence: Synthetic oligonucleotide
aagagaagactggggtggtgtccacgg

SEQ ID NO: 417084 - DNA, 26 bp, Artificial Sequence
  Description of Artificial Sequence: Synthetic oligonucleotide
agagaagactggggtggtgtccacgg

SEQ ID NO: 417085 - DNA, 25 bp, Artificial Sequence
  Description of Artificial Sequence: Synthetic oligonucleotide
gagaagactggggtggtgtccacgg

SEQ ID NO: 417086 - DNA, 25 bp, Artificial Sequence
  Description of Artificial Sequence: Synthetic oligonucleotide
agaagactggggtggtgtccacggg

SEQ ID NO: 417087 - DNA, 24 bp, Artificial Sequence
  Description of Artificial Sequence: Synthetic oligonucleotide
gaagactggggtggtgtccacggg

SEQ ID NO: 417088 - DNA, 24 bp, Artificial Sequence
  Description of Artificial Sequence: Synthetic oligonucleotide
aagactggggtggtgtccacgggc

SEQ ID NO: 417089 - DNA, 23 bp, Artificial Sequence
  Description of Artificial Sequence: Synthetic oligonucleotide
agactggggtggtgtccacgggc

SEQ ID NO: 417090 - DNA, 22 bp, Artificial Sequence
  Description of Artificial Sequence: Synthetic oligonucleotide
gactggggtggtgtccacgggc

SEQ ID NO: 417091 - DNA, 23 bp, Artificial Sequence
  Description of Artificial Sequence: Synthetic oligonucleotide
actggggtggtgtccacgggcct

SEQ ID NO: 417092 - DNA, 22 bp, Artificial Sequence
  Description of Artificial Sequence: Synthetic oligonucleotide
ctggggtggtgtccacgggcct

SEQ ID NO: 417093 - DNA, 24 bp, Artificial Sequence
  Description of Artificial Sequence: Synthetic oligonucleotide
tggggtggtgtccacgggcctgat

SEQ ID NO: 417094 - DNA, 23 bp, Artificial Sequence
  Description of Artificial Sequence: Synthetic oligonucleotide
ggggtggtgtccacgggcctgat

SEQ ID NO: 417095 - DNA, 23 bp, Artificial Sequence
  Description of Artificial Sequence: Synthetic oligonucleotide
gggtggtgtccacgggcctgatc

SEQ ID NO: 417096 - DNA, 24 bp, Artificial Sequence
  Description of Artificial Sequence: Synthetic oligonucleotide
ggtggtgtccacgggcctgatcca

SEQ ID NO: 417097 - DNA, 27 bp, Artificial Sequence
  Description of Artificial Sequence: Synthetic oligonucleotide
gtggtgtccacgggcctgatccagaat

SEQ ID NO: 417098 - DNA, 27 bp, Artificial Sequence
  Description of Artificial Sequence: Synthetic oligonucleotide
tggtgtccacgggcctgatccagaatg

SEQ ID NO: 417099 - DNA, 26 bp, Artificial Sequence
  Description of Artificial Sequence: Synthetic oligonucleotide
ggtgtccacgggcctgatccagaatg

SEQ ID NO: 417100 - DNA, 27 bp, Artificial Sequence
  Description of Artificial Sequence: Synthetic oligonucleotide
gtgtccacgggcctgatccagaatgga

SEQ ID NO: 417101 - DNA, 27 bp, Artificial Sequence
  Description of Artificial Sequence: Synthetic oligonucleotide
tgtccacgggcctgatccagaatggag

SEQ ID NO: 417102 - DNA, 27 bp, Artificial Sequence
  Description of Artificial Sequence: Synthetic oligonucleotide
gtccacgggcctgatccagaatggaga

SEQ ID NO: 417103 - DNA, 27 bp, Artificial Sequence
  Description of Artificial Sequence: Synthetic oligonucleotide
tccacgggcctgatccagaatggagac

SEQ ID NO: 417104 - DNA, 27 bp, Artificial Sequence
  Description of Artificial Sequence: Synthetic oligonucleotide
ccacgggcctgatccagaatggagact

SEQ ID NO: 417105 - DNA, 27 bp, Artificial Sequence
  Description of Artificial Sequence: Synthetic oligonucleotide
cacgggcctgatccagaatggagactg

SEQ ID NO: 417106 - DNA, 27 bp, Artificial Sequence
  Description of Artificial Sequence: Synthetic oligonucleotide
acgggcctgatccagaatggagactgg

SEQ ID NO: 417107 - DNA, 27 bp, Artificial Sequence
  Description of Artificial Sequence: Synthetic oligonucleotide
cgggcctgatccagaatggagactgga

SEQ ID NO: 417108 - DNA, 27 bp, Artificial Sequence
  Description of Artificial Sequence: Synthetic oligonucleotide
gggcctgatccagaatggagactggac

SEQ ID NO: 417109 - DNA, 30 bp, Artificial Sequence; identical to SEQ ID NO: 69927
  Description of Artificial Sequence: Synthetic oligonucleotide

SEQ ID NO: 417110 - DNA, 29 bp, Artificial Sequence
  Description of Artificial Sequence: Synthetic oligonucleotide
ccctggtgatgctggaaacagttcctcag

SEQ ID NO: 417111 - DNA, 30 bp, Artificial Sequence; identical to SEQ ID NO: 69929
  Description of Artificial Sequence: Synthetic oligonucleotide

SEQ ID NO: 417112 - DNA, 31 bp, Artificial Sequence; identical to SEQ ID NO: 69930
  Description of Artificial Sequence: Synthetic oligonucleotide

SEQ ID NO: 417113 - DNA, 31 bp, Artificial Sequence; identical to SEQ ID NO: 69931
  Description of Artificial Sequence: Synthetic oligonucleotide

SEQ ID NO: 417114 - DNA, 30 bp, Artificial Sequence; identical to SEQ ID NO: 69932
  Description of Artificial Sequence: Synthetic oligonucleotide

SEQ ID NO: 417115 - DNA, 31 bp, Artificial Sequence; identical to SEQ ID NO: 69933
  Description of Artificial Sequence: Synthetic oligonucleotide

SEQ ID NO: 417116 - DNA, 32 bp, Artificial Sequence; identical to SEQ ID NO: 69934
  Description of Artificial Sequence: Synthetic oligonucleotide

SEQ ID NO: 417117 - DNA, 31 bp, Artificial Sequence; identical to SEQ ID NO: 69935
  Description of Artificial Sequence: Synthetic oligonucleotide

SEQ ID NO: 417118 - DNA, 31 bp, Artificial Sequence; identical to SEQ ID NO: 69936
  Description of Artificial Sequence: Synthetic oligonucleotide

SEQ ID NO: 417119 - DNA, 30 bp, Artificial Sequence; identical to SEQ ID NO: 69937
  Description of Artificial Sequence: Synthetic oligonucleotide

SEQ ID NO: 417120 - DNA, 29 bp, Artificial Sequence
  Description of Artificial Sequence: Synthetic oligonucleotide
gctggaaacagttcctcagagtggagagg

SEQ ID NO: 417121 - DNA, 33 bp, Artificial Sequence; identical to SEQ ID NO: 69939
  Description of Artificial Sequence: Synthetic oligonucleotide

SEQ ID NO: 417122 - DNA, 34 bp, Artificial Sequence; identical to SEQ ID NO: 69940
  Description of Artificial Sequence: Synthetic oligonucleotide

SEQ ID NO: 417123 - DNA, 33 bp, Artificial Sequence; identical to SEQ ID NO: 69941
  Description of Artificial Sequence: Synthetic oligonucleotide

SEQ ID NO: 417124 - DNA, 33 bp, Artificial Sequence; identical to SEQ ID NO: 69942
  Description of Artificial Sequence: Synthetic oligonucleotide

SEQ ID NO: 417125 - DNA, 34 bp, Artificial Sequence; identical to SEQ ID NO: 69943
  Description of Artificial Sequence: Synthetic oligonucleotide

SEQ ID NO: 417126 - DNA, 33 bp, Artificial Sequence; identical to SEQ ID NO: 69944
  Description of Artificial Sequence: Synthetic oligonucleotide

SEQ ID NO: 417127 - DNA, 32 bp, Artificial Sequence; identical to SEQ ID NO: 69945
  Description of Artificial Sequence: Synthetic oligonucleotide

SEQ ID NO: 417128 - DNA, 31 bp, Artificial Sequence; identical to SEQ ID NO: 69946
  Description of Artificial Sequence: Synthetic oligonucleotide

SEQ ID NO: 417129 - DNA, 31 bp, Artificial Sequence; identical to SEQ ID NO: 69947
  Description of Artificial Sequence: Synthetic oligonucleotide

SEQ ID NO: 417130 - DNA, 30 bp, Artificial Sequence; identical to SEQ ID NO: 69948
  Description of Artificial Sequence: Synthetic oligonucleotide

SEQ ID NO: 417131 - DNA, 30 bp, Artificial Sequence; identical to SEQ ID NO: 69949
  Description of Artificial Sequence: Synthetic oligonucleotide

SEQ ID NO: 417132 - DNA, 29 bp, Artificial Sequence
  Description of Artificial Sequence: Synthetic oligonucleotide
tcctcagagtggagaggtttacacctgcc

SEQ ID NO: 417133 - DNA, 28 bp, Artificial Sequence
  Description of Artificial Sequence: Synthetic oligonucleotide
cctcagagtggagaggtttacacctgcc

SEQ ID NO: 417134 - DNA, 30 bp, Artificial Sequence; identical to SEQ ID NO: 69952
  Description of Artificial Sequence: Synthetic oligonucleotide

SEQ ID NO: 417135 - DNA, 31 bp, Artificial Sequence; identical to SEQ ID NO: 69953
  Description of Artificial Sequence: Synthetic oligonucleotide

SEQ ID NO: 417136 - DNA, 30 bp, Artificial Sequence; identical to SEQ ID NO: 69954
  Description of Artificial Sequence: Synthetic oligonucleotide

SEQ ID NO: 417137 - DNA, 30 bp, Artificial Sequence; identical to SEQ ID NO: 69955
  Description of Artificial Sequence: Synthetic oligonucleotide

SEQ ID NO: 417138 - DNA, 35 bp, Artificial Sequence; identical to SEQ ID NO: 69956
  Description of Artificial Sequence: Synthetic oligonucleotide

SEQ ID NO: 417139 - DNA, 34 bp, Artificial Sequence; identical to SEQ ID NO: 69957
  Description of Artificial Sequence: Synthetic oligonucleotide

SEQ ID NO: 417140 - DNA, 33 bp, Artificial Sequence; identical to SEQ ID NO: 69958
  Description of Artificial Sequence: Synthetic oligonucleotide

SEQ ID NO: 417141 - DNA, 33 bp, Artificial Sequence; identical to SEQ ID NO: 69959
  Description of Artificial Sequence: Synthetic oligonucleotide

SEQ ID NO: 417142 - DNA, 32 bp, Artificial Sequence; identical to SEQ ID NO: 69960
  Description of Artificial Sequence: Synthetic oligonucleotide

SEQ ID NO: 417143 - DNA, 31 bp, Artificial Sequence; identical to SEQ ID NO: 69961
  Description of Artificial Sequence: Synthetic oligonucleotide

SEQ ID NO: 417144 - DNA, 31 bp, Artificial Sequence; identical to SEQ ID NO: 69962
  Description of Artificial Sequence: Synthetic oligonucleotide

SEQ ID NO: 417145 - DNA, 30 bp, Artificial Sequence; identical to SEQ ID NO: 69963
  Description of Artificial Sequence: Synthetic oligonucleotide

SEQ ID NO: 417146 - DNA, 30 bp, Artificial Sequence; identical to SEQ ID NO: 69964
  Description of Artificial Sequence: Synthetic oligonucleotide

SEQ ID NO: 417147 - DNA, 32 bp, Artificial Sequence; identical to SEQ ID NO: 69965
  Description of Artificial Sequence: Synthetic oligonucleotide

SEQ ID NO: 417148 - DNA, 31 bp, Artificial Sequence; identical to SEQ ID NO: 69966
  Description of Artificial Sequence: Synthetic oligonucleotide

SEQ ID NO: 417149 - DNA, 30 bp, Artificial Sequence; identical to SEQ ID NO: 69967
  Description of Artificial Sequence: Synthetic oligonucleotide

SEQ ID NO: 417150 - DNA, 29 bp, Artificial Sequence
  Description of Artificial Sequence: Synthetic oligonucleotide
cagaaaggacactctggacttccgccaac

SEQ ID NO: 417151 - DNA, 30 bp, Artificial Sequence; identical to SEQ ID NO: 69969
  Description of Artificial Sequence: Synthetic oligonucleotide

SEQ ID NO: 417152 - DNA, 29 bp, Artificial Sequence
  Description of Artificial Sequence: Synthetic oligonucleotide
gaaaggacactctggacttccgccaacag

SEQ ID NO: 417153 - DNA, 29 bp, Artificial Sequence
  Description of Artificial Sequence: Synthetic oligonucleotide
aaaggacactctggacttccgccaacagg

SEQ ID NO: 417154 - DNA, 28 bp, Artificial Sequence
  Description of Artificial Sequence: Synthetic oligonucleotide
aaggacactctggacttccgccaacagg

SEQ ID NO: 417155 - DNA, 27 bp, Artificial Sequence
  Description of Artificial Sequence: Synthetic oligonucleotide
aggacactctggacttccgccaacagg

SEQ ID NO: 417156 - DNA, 27 bp, Artificial Sequence
  Description of Artificial Sequence: Synthetic oligonucleotide
ggacactctggacttccgccaacagga

SEQ ID NO: 417157 - DNA, 29 bp, Artificial Sequence
  Description of Artificial Sequence: Synthetic oligonucleotide
gacactctggacttccgccaacaggattc

SEQ ID NO: 417158 - DNA, 29 bp, Artificial Sequence
  Description of Artificial Sequence: Synthetic oligonucleotide
acactctggacttccgccaacaggattcc

SEQ ID NO: 417159 - DNA, 28 bp, Artificial Sequence
  Description of Artificial Sequence: Synthetic oligonucleotide
cactctggacttccgccaacaggattcc

SEQ ID NO: 417160 - DNA, 29 bp, Artificial Sequence
  Description of Artificial Sequence: Synthetic oligonucleotide
actctggacttccgccaacaggattcctg

SEQ ID NO: 417161 - DNA, 28 bp, Artificial Sequence
  Description of Artificial Sequence: Synthetic oligonucleotide
ctctggacttccgccaacaggattcctg

SEQ ID NO: 417162 - DNA, 29 bp, Artificial Sequence
  Description of Artificial Sequence: Synthetic oligonucleotide
tctggacttccgccaacaggattcctgag

SEQ ID NO: 417163 - DNA, 28 bp, Artificial Sequence
  Description of Artificial Sequence: Synthetic oligonucleotide
ctggacttccgccaacaggattcctgag

SEQ ID NO: 417164 - DNA, 28 bp, Artificial Sequence
  Description of Artificial Sequence: Synthetic oligonucleotide
tggacttccgccaacaggattcctgagc

SEQ ID NO: 417165 - DNA, 27 bp, Artificial Sequence
  Description of Artificial Sequence: Synthetic oligonucleotide
ggacttccgccaacaggattcctgagc

SEQ ID NO: 417166 - DNA, 28 bp, Artificial Sequence
  Description of Artificial Sequence: Synthetic oligonucleotide
gacttccgccaacaggattcctgagctg

SEQ ID NO: 417167 - DNA, 21 bp, Artificial Sequence
  Description of Artificial Sequence: Synthetic oligonucleotide
gacctcctggagcggaggcgc

SEQ ID NO: 417168 - DNA, 21 bp, Artificial Sequence
  Description of Artificial Sequence: Synthetic oligonucleotide
acctcctggagcggaggcgcg

SEQ ID NO: 417169 - DNA, 20 bp, Artificial Sequence
  Description of Artificial Sequence: Synthetic oligonucleotide
cctcctggagcggaggcgcg

SEQ ID NO: 417170 - DNA, 20 bp, Artificial Sequence
  Description of Artificial Sequence: Synthetic oligonucleotide
ctcctggagcggaggcgcgc

SEQ ID NO: 417171 - DNA, 20 bp, Artificial Sequence
  Description of Artificial Sequence: Synthetic oligonucleotide
tcctggagcggaggcgcgcc

SEQ ID NO: 417172 - DNA, 20 bp, Artificial Sequence
  Description of Artificial Sequence: Synthetic oligonucleotide
cctggagcggaggcgcgcct

SEQ ID NO: 417173 - DNA, 20 bp, Artificial Sequence
  Description of Artificial Sequence: Synthetic oligonucleotide
ctggagcggaggcgcgccgt

SEQ ID NO: 417174 - DNA, 20 bp, Artificial Sequence
  Description of Artificial Sequence: Synthetic oligonucleotide
tggagcggaggcgcgccgct

SEQ ID NO: 417175 - DNA, 20 bp, Artificial Sequence
  Description of Artificial Sequence: Synthetic oligonucleotide
ggagcggaggcgcgccgctt

SEQ ID NO: 417176 - DNA, 20 bp, Artificial Sequence
  Description of Artificial Sequence: Synthetic oligonucleotide
gagcggaggcgcgccgcgtt

SEQ ID NO: 417177 - DNA, 20 bp, Artificial Sequence
  Description of Artificial Sequence: Synthetic oligonucleotide
agcggaggcgcgccgcggtt

SEQ ID NO: 417178 - DNA, 20 bp, Artificial Sequence
  Description of Artificial Sequence: Synthetic oligonucleotide
gcggaggcgcgccgcggttt

SEQ ID NO: 417179 - DNA, 20 bp, Artificial Sequence
  Description of Artificial Sequence: Synthetic oligonucleotide
cggaggcgcgccgcggtgtt

SEQ ID NO: 417180 - DNA, 20 bp, Artificial Sequence
  Description of Artificial Sequence: Synthetic oligonucleotide
ggaggcgcgccgcggtggat

SEQ ID NO: 417181 - DNA, 29 bp, Artificial Sequence
  Description of Artificial Sequence: Synthetic oligonucleotide
tccataaccaagaggagtacgcgcgcttc

SEQ ID NO: 417182 - DNA, 28 bp, Artificial Sequence
  Description of Artificial Sequence: Synthetic oligonucleotide
ccataaccaagaggagtacgcgcgcttc

SEQ ID NO: 417183 - DNA, 28 bp, Artificial Sequence
  Description of Artificial Sequence: Synthetic oligonucleotide
cataaccaagaggagtacgcgcgcttcg

SEQ ID NO: 417184 - DNA, 29 bp, Artificial Sequence
  Description of Artificial Sequence: Synthetic oligonucleotide
ataaccaagaggagtacgcgcgcttcgac

SEQ ID NO: 417185 - DNA, 28 bp, Artificial Sequence
  Description of Artificial Sequence: Synthetic oligonucleotide
taaccaagaggagtacgcgcgcttcgac

SEQ ID NO: 417186 - DNA, 27 bp, Artificial Sequence
  Description of Artificial Sequence: Synthetic oligonucleotide
aaccaagaggagtacgcgcgcttcgac

SEQ ID NO: 417187 - DNA, 27 bp, Artificial Sequence
  Description of Artificial Sequence: Synthetic oligonucleotide
accaagaggagtacgcgcgcttcgaca

SEQ ID NO: 417188 - DNA, 26 bp, Artificial Sequence
  Description of Artificial Sequence: Synthetic oligonucleotide
ccaagaggagtacgcgcgcttcgaca

SEQ ID NO: 417189 - DNA, 26 bp, Artificial Sequence
  Description of Artificial Sequence: Synthetic oligonucleotide
caagaggagtacgcgcgcttcgacag

SEQ ID NO: 417190 - DNA, 26 bp, Artificial Sequence
  Description of Artificial Sequence: Synthetic oligonucleotide
aagaggagtacgcgcgcttcgacagc

SEQ ID NO: 417191 - DNA, 40 bp, Artificial Sequence; identical to SEQ ID NO: 70009
  Description of Artificial Sequence: Synthetic oligonucleotide

SEQ ID NO: 417192 - DNA, 39 bp, Artificial Sequence; identical to SEQ ID NO: 70010
  Description of Artificial Sequence: Synthetic oligonucleotide

SEQ ID NO: 417193 - DNA, 38 bp, Artificial Sequence; identical to SEQ ID NO: 70011
  Description of Artificial Sequence: Synthetic oligonucleotide

SEQ ID NO: 417194 - DNA, 37 bp, Artificial Sequence; identical to SEQ ID NO: 70012
  Description of Artificial Sequence: Synthetic oligonucleotide

SEQ ID NO: 417195 - DNA, 37 bp, Artificial Sequence; identical to SEQ ID NO: 70013
  Description of Artificial Sequence: Synthetic oligonucleotide

SEQ ID NO: 417196 - DNA, 36 bp, Artificial Sequence; identical to SEQ ID NO: 70014
  Description of Artificial Sequence: Synthetic oligonucleotide

SEQ ID NO: 417197 - DNA, 35 bp, Artificial Sequence; identical to SEQ ID NO: 70015
  Description of Artificial Sequence: Synthetic oligonucleotide

SEQ ID NO: 417198 - DNA, 35 bp, Artificial Sequence; identical to SEQ ID NO: 70016
  Description of Artificial Sequence: Synthetic oligonucleotide

SEQ ID NO: 417199 - DNA, 35 bp, Artificial Sequence; identical to SEQ ID NO: 70017
  Description of Artificial Sequence: Synthetic oligonucleotide

SEQ ID NO: 417200 - DNA, 34 bp, Artificial Sequence; identical to SEQ ID NO: 70018
  Description of Artificial Sequence: Synthetic oligonucleotide

SEQ ID NO: 417201 - DNA, 35 bp, Artificial Sequence; identical to SEQ ID NO: 70019
  Description of Artificial Sequence: Synthetic oligonucleotide

SEQ ID NO: 417202 - DNA, 34 bp, Artificial Sequence; identical to SEQ ID NO: 70020
  Description of Artificial Sequence: Synthetic oligonucleotide

SEQ ID NO: 417203 - DNA, 33 bp, Artificial Sequence; identical to SEQ ID NO: 70021
  Description of Artificial Sequence: Synthetic oligonucleotide

SEQ ID NO: 417204 - DNA, 33 bp, Artificial Sequence; identical to SEQ ID NO: 70022
  Description of Artificial Sequence: Synthetic oligonucleotide

SEQ ID NO: 417205 - DNA, 32 bp, Artificial Sequence; identical to SEQ ID NO: 70023
  Description of Artificial Sequence: Synthetic oligonucleotide

SEQ ID NO: 417206 - DNA, 32 bp, Artificial Sequence; identical to SEQ ID NO: 70024
  Description of Artificial Sequence: Synthetic oligonucleotide

SEQ ID NO: 417207 - DNA, 31 bp, Artificial Sequence; identical to SEQ ID NO: 70025
  Description of Artificial Sequence: Synthetic oligonucleotide

SEQ ID NO: 417208 - DNA, 30 bp, Artificial Sequence; identical to SEQ ID NO: 70026
  Description of Artificial Sequence: Synthetic oligonucleotide

SEQ ID NO: 417209 - DNA, 24 bp, Artificial Sequence
  Description of Artificial Sequence: Synthetic oligonucleotide
gacagcgacgtgggggagttccga

SEQ ID NO: 417210 - DNA, 24 bp, Artificial Sequence
  Description of Artificial Sequence: Synthetic oligonucleotide
acagcgacgtgggggagttccgag

SEQ ID NO: 417211 - DNA, 23 bp, Artificial Sequence
  Description of Artificial Sequence: Synthetic oligonucleotide
cagcgacgtgggggagttccgag

SEQ ID NO: 417212 - DNA, 23 bp, Artificial Sequence
  Description of Artificial Sequence: Synthetic oligonucleotide
agcgacgtgggggagttccgagc

SEQ ID NO: 417213 - DNA, 22 bp, Artificial Sequence
  Description of Artificial Sequence: Synthetic oligonucleotide
gcgacgtgggggagttccgagc

SEQ ID NO: 417214 - DNA, 22 bp, Artificial Sequence
  Description of Artificial Sequence: Synthetic oligonucleotide
cgacgtgggggagttccgagcg

SEQ ID NO: 417215 - DNA, 23 bp, Artificial Sequence
  Description of Artificial Sequence: Synthetic oligonucleotide
gacgtgggggagttccgagcggt

SEQ ID NO: 417216 - DNA, 24 bp, Artificial Sequence
  Description of Artificial Sequence: Synthetic oligonucleotide
acgtgggggagttccgagcggtga

SEQ ID NO: 417217 - DNA, 23 bp, Artificial Sequence
  Description of Artificial Sequence: Synthetic oligonucleotide
cgtgggggagttccgagcggtga

SEQ ID NO: 417218 - DNA, 23 bp, Artificial Sequence
  Description of Artificial Sequence: Synthetic oligonucleotide
gtgggggagttccgagcggtgac

SEQ ID NO: 417219 - DNA, 23 bp, Artificial Sequence
  Description of Artificial Sequence: Synthetic oligonucleotide
tgggggagttccgagcggtgacg

SEQ ID NO: 417220 - DNA, 22 bp, Artificial Sequence
  Description of Artificial Sequence: Synthetic oligonucleotide
gggggagttccgagcggtgacg

SEQ ID NO: 417221 - DNA, 23 bp, Artificial Sequence
  Description of Artificial Sequence: Synthetic oligonucleotide
ggggagttccgagcggtgacgga

SEQ ID NO: 417222 - DNA, 23 bp, Artificial Sequence
  Description of Artificial Sequence: Synthetic oligonucleotide
gggagttccgagcggtgacggag

SEQ ID NO: 417223 - DNA, 24 bp, Artificial Sequence
  Description of Artificial Sequence: Synthetic oligonucleotide
ggagttccgagcggtgacggagct

SEQ ID NO: 417224 - DNA, 24 bp, Artificial Sequence
  Description of Artificial Sequence: Synthetic oligonucleotide
gagttccgagcggtgacggagctg

SEQ ID NO: 417225 - DNA, 24 bp, Artificial Sequence
  Description of Artificial Sequence: Synthetic oligonucleotide
agttccgagcggtgacggagctgg

SEQ ID NO: 417226 - DNA, 23 bp, Artificial Sequence
  Description of Artificial Sequence: Synthetic oligonucleotide
gttccgagcggtgacggagctgg

SEQ ID NO: 417227 - DNA, 23 bp, Artificial Sequence
  Description of Artificial Sequence: Synthetic oligonucleotide
ttccgagcggtgacggagctggg

SEQ ID NO: 417228 - DNA, 22 bp, Artificial Sequence
  Description of Artificial Sequence: Synthetic oligonucleotide
tccgagcggtgacggagctggg

SEQ ID NO: 417229 - DNA, 21 bp, Artificial Sequence
  Description of Artificial Sequence: Synthetic oligonucleotide
ccgagcggtgacggagctggg

SEQ ID NO: 417230 - DNA, 21 bp, Artificial Sequence
  Description of Artificial Sequence: Synthetic oligonucleotide
cgagcggtgacggagctgggg

SEQ ID NO: 417231 - DNA, 21 bp, Artificial Sequence
  Description of Artificial Sequence: Synthetic oligonucleotide
gagcggtgacggagctggggc

SEQ ID NO: 417232 - DNA, 21 bp, Artificial Sequence
  Description of Artificial Sequence: Synthetic oligonucleotide
agcggtgacggagctggggcg

SEQ ID NO: 417233 - DNA, 28 bp, Artificial Sequence
  Description of Artificial Sequence: Synthetic oligonucleotide
cagaaggacttcctggaagacaggcgtg

SEQ ID NO: 417234 - DNA, 28 bp, Artificial Sequence
  Description of Artificial Sequence: Synthetic oligonucleotide
agaaggacttcctggaagacaggcgtgc

SEQ ID NO: 417235 - DNA, 27 bp, Artificial Sequence
  Description of Artificial Sequence: Synthetic oligonucleotide
gaaggacttcctggaagacaggcgtgc

SEQ ID NO: 417236 - DNA, 27 bp, Artificial Sequence
  Description of Artificial Sequence: Synthetic oligonucleotide
aaggacttcctggaagacaggcgtgcc

SEQ ID NO: 417237 - DNA, 26 bp, Artificial Sequence
  Description of Artificial Sequence: Synthetic oligonucleotide
aggacttcctggaagacaggcgtgcc

SEQ ID NO: 417238 - DNA, 25 bp, Artificial Sequence
  Description of Artificial Sequence: Synthetic oligonucleotide
ggacttcctggaagacaggcgtgcc

SEQ ID NO: 417239 - DNA, 25 bp, Artificial Sequence
  Description of Artificial Sequence: Synthetic oligonucleotide
gacttcctggaagacaggcgtgccg

SEQ ID NO: 417240 - DNA, 25 bp, Artificial Sequence
  Description of Artificial Sequence: Synthetic oligonucleotide
acttcctggaagacaggcgtgccgc

SEQ ID NO: 417241 - DNA, 24 bp, Artificial Sequence
  Description of Artificial Sequence: Synthetic oligonucleotide
cttcctggaagacaggcgtgccgc

SEQ ID NO: 417242 - DNA, 24 bp, Artificial Sequence
  Description of Artificial Sequence: Synthetic oligonucleotide
ttcctggaagacaggcgtgccgcg

SEQ ID NO: 417243 - DNA, 23 bp, Artificial Sequence
  Description of Artificial Sequence: Synthetic oligonucleotide
tcctggaagacaggcgtgccgcg

SEQ ID NO: 417244 - DNA, 22 bp, Artificial Sequence
  Description of Artificial Sequence: Synthetic oligonucleotide
cctggaagacaggcgtgccgcg

SEQ ID NO: 417245 - DNA, 23 bp, Artificial Sequence
  Description of Artificial Sequence: Synthetic oligonucleotide
ctggaagacaggcgtgccgcggt

SEQ ID NO: 417246 - DNA, 23 bp, Artificial Sequence
  Description of Artificial Sequence: Synthetic oligonucleotide
tggaagacaggcgtgccgcggtg

SEQ ID NO: 417247 - DNA, 22 bp, Artificial Sequence
  Description of Artificial Sequence: Synthetic oligonucleotide
ggaagacaggcgtgccgcggtg

SEQ ID NO: 417248 - DNA, 23 bp, Artificial Sequence
  Description of Artificial Sequence: Synthetic oligonucleotide
gaagacaggcgtgccgcggtgga

SEQ ID NO: 417249 - DNA, 24 bp, Artificial Sequence
  Description of Artificial Sequence: Synthetic oligonucleotide
aagacaggcgtgccgcggtggaca

SEQ ID NO: 417250 - DNA, 23 bp, Artificial Sequence
  Description of Artificial Sequence: Synthetic oligonucleotide
agacaggcgtgccgcggtggaca

SEQ ID NO: 417251 - DNA, 22 bp, Artificial Sequence
  Description of Artificial Sequence: Synthetic oligonucleotide
gacaggcgtgccgcggtggaca

SEQ ID NO: 417252 - DNA, 22 bp, Artificial Sequence
  Description of Artificial Sequence: Synthetic oligonucleotide
acaggcgtgccgcggtggacac

SEQ ID NO: 417253 - DNA, 21 bp, Artificial Sequence
  Description of Artificial Sequence: Synthetic oligonucleotide
caggcgtgccgcggtggacac

SEQ ID NO: 417254 - DNA, 33 bp, Artificial Sequence; identical to SEQ ID NO: 70128
  Description of Artificial Sequence: Synthetic oligonucleotide

SEQ ID NO: 417255 - DNA, 33 bp, Artificial Sequence; identical to SEQ ID NO: 70129
  Description of Artificial Sequence: Synthetic oligonucleotide

SEQ ID NO: 417256 - DNA, 32 bp, Artificial Sequence; identical to SEQ ID NO: 70130
  Description of Artificial Sequence: Synthetic oligonucleotide

SEQ ID NO: 417257 - DNA, 33 bp, Artificial Sequence; identical to SEQ ID NO: 70131
  Description of Artificial Sequence: Synthetic oligonucleotide

SEQ ID NO: 417258 - DNA, 33 bp, Artificial Sequence; identical to SEQ ID NO: 70132
  Description of Artificial Sequence: Synthetic oligonucleotide

SEQ ID NO: 417259 - DNA, 34 bp, Artificial Sequence; identical to SEQ ID NO: 70133
  Description of Artificial Sequence: Synthetic oligonucleotide

SEQ ID NO: 417260 - DNA, 36 bp, Artificial Sequence; identical to SEQ ID NO: 70134
  Description of Artificial Sequence: Synthetic oligonucleotide

SEQ ID NO: 417261 - DNA, 35 bp, Artificial Sequence; identical to SEQ ID NO: 70135
  Description of Artificial Sequence: Synthetic oligonucleotide

SEQ ID NO: 417262 - DNA, 34 bp, Artificial Sequence; identical to SEQ ID NO: 70136
  Description of Artificial Sequence: Synthetic oligonucleotide

SEQ ID NO: 417263 - DNA, 34 bp, Artificial Sequence; identical to SEQ ID NO: 70137
  Description of Artificial Sequence: Synthetic oligonucleotide

SEQ ID NO: 417264 - DNA, 35 bp, Artificial Sequence; identical to SEQ ID NO: 70138
  Description of Artificial Sequence: Synthetic oligonucleotide

SEQ ID NO: 417265 - DNA, 34 bp, Artificial Sequence; identical to SEQ ID NO: 70139
  Description of Artificial Sequence: Synthetic oligonucleotide

SEQ ID NO: 417266 - DNA, 34 bp, Artificial Sequence; identical to SEQ ID NO: 70140
  Description of Artificial Sequence: Synthetic oligonucleotide

SEQ ID NO: 417267 - DNA, 34 bp, Artificial Sequence; identical to SEQ ID NO: 70141
  Description of Artificial Sequence: Synthetic oligonucleotide

SEQ ID NO: 417268 - DNA, 33 bp, Artificial Sequence; identical to SEQ ID NO: 70142
  Description of Artificial Sequence: Synthetic oligonucleotide

SEQ ID NO: 417269 - DNA, 33 bp, Artificial Sequence; identical to SEQ ID NO: 70143
  Description of Artificial Sequence: Synthetic oligonucleotide

SEQ ID NO: 417270 - DNA, 32 bp, Artificial Sequence; identical to SEQ ID NO: 70144
  Description of Artificial Sequence: Synthetic oligonucleotide

SEQ ID NO: 417271 - DNA, 34 bp, Artificial Sequence; identical to SEQ ID NO: 70145
  Description of Artificial Sequence: Synthetic oligonucleotide

SEQ ID NO: 417272 - DNA, 33 bp, Artificial Sequence; identical to SEQ ID NO: 70146
  Description of Artificial Sequence: Synthetic oligonucleotide

SEQ ID NO: 417273 - DNA, 32 bp, Artificial Sequence; identical to SEQ ID NO: 70147
  Description of Artificial Sequence: Synthetic oligonucleotide

SEQ ID NO: 417274 - DNA, 31 bp, Artificial Sequence; identical to SEQ ID NO: 70148
  Description of Artificial Sequence: Synthetic oligonucleotide

SEQ ID NO: 417275 - DNA, 31 bp, Artificial Sequence; identical to SEQ ID NO: 70149
  Description of Artificial Sequence: Synthetic oligonucleotide

SEQ ID NO: 417276 - DNA, 30 bp, Artificial Sequence; identical to SEQ ID NO: 70150
  Description of Artificial Sequence: Synthetic oligonucleotide

SEQ ID NO: 417277 - DNA, 29 bp, Artificial Sequence
  Description of Artificial Sequence: Synthetic oligonucleotide
ctataaccaggaggagtacgtgcgcttcg

SEQ ID NO: 417278 - DNA, 30 bp, Artificial Sequence; identical to SEQ ID NO: 70152
  Description of Artificial Sequence: Synthetic oligonucleotide

SEQ ID NO: 417279 - DNA, 28 bp, Artificial Sequence
  Description of Artificial Sequence: Synthetic oligonucleotide
caagaggagtacgtgcgcttcgacagtg

SEQ ID NO: 417280 - DNA, 29 bp, Artificial Sequence
  Description of Artificial Sequence: Synthetic oligonucleotide
aagaggagtacgtgcgcttcgacagtgac

SEQ ID NO: 417281 - DNA, 28 bp, Artificial Sequence
  Description of Artificial Sequence: Synthetic oligonucleotide
agaggagtacgtgcgcttcgacagtgac

SEQ ID NO: 417282 - DNA, 27 bp, Artificial Sequence
  Description of Artificial Sequence: Synthetic oligonucleotide
gaggagtacgtgcgcttcgacagtgac

SEQ ID NO: 417283 - DNA, 27 bp, Artificial Sequence
  Description of Artificial Sequence: Synthetic oligonucleotide
aggagtacgtgcgcttcgacagtgacg

SEQ ID NO: 417284 - DNA, 27 bp, Artificial Sequence
  Description of Artificial Sequence: Synthetic oligonucleotide
ggagtacgtgcgcttcgacagtgacgt

SEQ ID NO: 417285 - DNA, 27 bp, Artificial Sequence
  Description of Artificial Sequence: Synthetic oligonucleotide
gagtacgtgcgcttcgacagtgacgtg

SEQ ID NO: 417286 - DNA, 27 bp, Artificial Sequence
  Description of Artificial Sequence: Synthetic oligonucleotide
agtacgtgcgcttcgacagtgacgtgg

SEQ ID NO: 417287 - DNA, 26 bp, Artificial Sequence
  Description of Artificial Sequence: Synthetic oligonucleotide
gtacgtgcgcttcgacagtgacgtgg

SEQ ID NO: 417288 - DNA, 26 bp, Artificial Sequence
  Description of Artificial Sequence: Synthetic oligonucleotide
tacgtgcgcttcgacagtgacgtggg

SEQ ID NO: 417289 - DNA, 25 bp, Artificial Sequence
  Description of Artificial Sequence: Synthetic oligonucleotide
acgtgcgcttcgacagtgacgtggg

SEQ ID NO: 417290 - DNA, 24 bp, Artificial Sequence
  Description of Artificial Sequence: Synthetic oligonucleotide
cgtgcgcttcgacagtgacgtggg

SEQ ID NO: 417291 - DNA, 24 bp, Artificial Sequence
  Description of Artificial Sequence: Synthetic oligonucleotide
gtgcgcttcgacagtgacgtgggg

SEQ ID NO: 417292 - DNA, 25 bp, Artificial Sequence
  Description of Artificial Sequence: Synthetic oligonucleotide
tgcgcttcgacagtgacgtggggga

SEQ ID NO: 417293 - DNA, 24 bp, Artificial Sequence
  Description of Artificial Sequence: Synthetic oligonucleotide
gcgcttcgacagtgacgtggggga

SEQ ID NO: 417294 - DNA, 26 bp, Artificial Sequence
  Description of Artificial Sequence: Synthetic oligonucleotide
cgcttcgacagtgacgtgggggagtt

SEQ ID NO: 417295 - DNA, 26 bp, Artificial Sequence
  Description of Artificial Sequence: Synthetic oligonucleotide
gcttcgacagtgacgtgggggagttc

SEQ ID NO: 417296 - DNA, 26 bp, Artificial Sequence
  Description of Artificial Sequence: Synthetic oligonucleotide
cttcgacagtgacgtgggggagttcc

SEQ ID NO: 417297 - DNA, 26 bp, Artificial Sequence
  Description of Artificial Sequence: Synthetic oligonucleotide
ttcgacagtgacgtgggggagttccg

SEQ ID NO: 417298 - DNA, 25 bp, Artificial Sequence
  Description of Artificial Sequence: Synthetic oligonucleotide
tcgacagtgacgtgggggagttccg

SEQ ID NO: 417299 - DNA, 24 bp, Artificial Sequence
  Description of Artificial Sequence: Synthetic oligonucleotide
cgacagtgacgtgggggagttccg

SEQ ID NO: 417300 - DNA, 24 bp, Artificial Sequence
  Description of Artificial Sequence: Synthetic oligonucleotide
gacagtgacgtgggggagttccgg

SEQ ID NO: 417301 - DNA, 24 bp, Artificial Sequence
  Description of Artificial Sequence: Synthetic oligonucleotide
acagtgacgtgggggagttccggg

SEQ ID NO: 417302 - DNA, 23 bp, Artificial Sequence
  Description of Artificial Sequence: Synthetic oligonucleotide
cagtgacgtgggggagttccggg

SEQ ID NO: 417303 - DNA, 23 bp, Artificial Sequence
  Description of Artificial Sequence: Synthetic oligonucleotide
agtgacgtgggggagttccgggc

SEQ ID NO: 417304 - DNA, 22 bp, Artificial Sequence
  Description of Artificial Sequence: Synthetic oligonucleotide
gtgacgtgggggagttccgggc

SEQ ID NO: 417305 - DNA, 22 bp, Artificial Sequence
  Description of Artificial Sequence: Synthetic oligonucleotide
tgacgtgggggagttccgggcg

SEQ ID NO: 417306 - DNA, 37 bp, Artificial Sequence
  Description of Artificial Sequence: Synthetic oligonucleotide
agatacttctataaccaagaggagtacgtgcgctttg

SEQ ID NO: 417307 - DNA, 36 bp, Artificial Sequence
  Description of Artificial Sequence: Synthetic oligonucleotide
gatacttctataaccaagaggagtacgtgcgctttg

SEQ ID NO: 417308 - DNA, 37 bp, Artificial Sequence
  Description of Artificial Sequence: Synthetic oligonucleotide
atacttctataaccaagaggagtacgtgcgctttgac

SEQ ID NO: 417309 - DNA, 36 bp, Artificial Sequence
  Description of Artificial Sequence: Synthetic oligonucleotide
tacttctataaccaagaggagtacgtgcgctttgac

SEQ ID NO: 417310 - DNA, 35 bp, Artificial Sequence
  Description of Artificial Sequence: Synthetic oligonucleotide
acttctataaccaagaggagtacgtgcgctttgac

SEQ ID NO: 417311 - DNA, 34 bp, Artificial Sequence
  Description of Artificial Sequence: Synthetic oligonucleotide
cttctataaccaagaggagtacgtgcgctttgac

SEQ ID NO: 417312 - DNA, 35 bp, Artificial Sequence
  Description of Artificial Sequence: Synthetic oligonucleotide
ttctataaccaagaggagtacgtgcgctttgacag

SEQ ID NO: 417313 - DNA, 34 bp, Artificial Sequence
  Description of Artificial Sequence: Synthetic oligonucleotide
tctataaccaagaggagtacgtgcgctttgacag

SEQ ID NO: 417314 - DNA, 33 bp, Artificial Sequence
  Description of Artificial Sequence: Synthetic oligonucleotide
ctataaccaagaggagtacgtgcgctttgacag

SEQ ID NO: 417315 - DNA, 33 bp, Artificial Sequence
  Description of Artificial Sequence: Synthetic oligonucleotide
tataaccaagaggagtacgtgcgctttgacagc

SEQ ID NO: 417316 - DNA, 32 bp, Artificial Sequence
  Description of Artificial Sequence: Synthetic oligonucleotide
ataaccaagaggagtacgtgcgctttgacagc

SEQ ID NO: 417317 - DNA, 31 bp, Artificial Sequence
  Description of Artificial Sequence: Synthetic oligonucleotide
taaccaagaggagtacgtgcgctttgacagc

SEQ ID NO: 417318 - DNA, 30 bp, Artificial Sequence
  Description of Artificial Sequence: Synthetic oligonucleotide
aaccaagaggagtacgtgcgctttgacagc

SEQ ID NO: 417319 - DNA, 29 bp, Artificial Sequence
  Description of Artificial Sequence: Synthetic oligonucleotide
accaagaggagtacgtgcgctttgacagc

SEQ ID NO: 417320 - DNA, 28 bp, Artificial Sequence
  Description of Artificial Sequence: Synthetic oligonucleotide
ccaagaggagtacgtgcgctttgacagc

SEQ ID NO: 417321 - DNA, 28 bp, Artificial Sequence
  Description of Artificial Sequence: Synthetic oligonucleotide
caagaggagtacgtgcgctttgacagcg

SEQ ID NO: 417322 - DNA, 29 bp, Artificial Sequence
  Description of Artificial Sequence: Synthetic oligonucleotide
aagaggagtacgtgcgctttgacagcgac

SEQ ID NO: 417323 - DNA, 28 bp, Artificial Sequence
  Description of Artificial Sequence: Synthetic oligonucleotide
agaggagtacgtgcgctttgacagcgac

SEQ ID NO: 417324 - DNA, 27 bp, Artificial Sequence
  Description of Artificial Sequence: Synthetic oligonucleotide
gaggagtacgtgcgctttgacagcgac

SEQ ID NO: 417325 - DNA, 27 bp, Artificial Sequence
  Description of Artificial Sequence: Synthetic oligonucleotide
aggagtacgtgcgctttgacagcgacg

SEQ ID NO: 417326 - DNA, 27 bp, Artificial Sequence
  Description of Artificial Sequence: Synthetic oligonucleotide
ggagtacgtgcgctttgacagcgacgt

SEQ ID NO: 417327 - DNA, 27 bp, Artificial Sequence
  Description of Artificial Sequence: Synthetic oligonucleotide
gagtacgtgcgctttgacagcgacgtg

SEQ ID NO: 417328 - DNA, 27 bp, Artificial Sequence
  Description of Artificial Sequence: Synthetic oligonucleotide
agtacgtgcgctttgacagcgacgtgg

SEQ ID NO: 417329 - DNA, 26 bp, Artificial Sequence
  Description of Artificial Sequence: Synthetic oligonucleotide
gtacgtgcgctttgacagcgacgtgg

SEQ ID NO: 417330 - DNA, 26 bp, Artificial Sequence
  Description of Artificial Sequence: Synthetic oligonucleotide
tacgtgcgctttgacagcgacgtggg

SEQ ID NO: 417331 - DNA, 25 bp, Artificial Sequence
  Description of Artificial Sequence: Synthetic oligonucleotide
acgtgcgctttgacagcgacgtggg

SEQ ID NO: 417332 - DNA, 24 bp, Artificial Sequence
  Description of Artificial Sequence: Synthetic oligonucleotide
cgtgcgctttgacagcgacgtggg

SEQ ID NO: 417333 - DNA, 24 bp, Artificial Sequence
  Description of Artificial Sequence: Synthetic oligonucleotide
gtgcgctttgacagcgacgtgggg

SEQ ID NO: 417334 - DNA, 25 bp, Artificial Sequence
  Description of Artificial Sequence: Synthetic oligonucleotide
tgcgctttgacagcgacgtggggga

SEQ ID NO: 417335 - DNA, 24 bp, Artificial Sequence
  Description of Artificial Sequence: Synthetic oligonucleotide
gcgctttgacagcgacgtggggga

SEQ ID NO: 417336 - DNA, 26 bp, Artificial Sequence
  Description of Artificial Sequence: Synthetic oligonucleotide
cgctttgacagcgacgtgggggagtt

SEQ ID NO: 417337 - DNA, 26 bp, Artificial Sequence
  Description of Artificial Sequence: Synthetic oligonucleotide
gctttgacagcgacgtgggggagttc

SEQ ID NO: 417338 - DNA, 26 bp, Artificial Sequence
  Description of Artificial Sequence: Synthetic oligonucleotide
ctttgacagcgacgtgggggagttcc

SEQ ID NO: 417339 - DNA, 26 bp, Artificial Sequence
  Description of Artificial Sequence: Synthetic oligonucleotide
tttgacagcgacgtgggggagttccg

SEQ ID NO: 417340 - DNA, 25 bp, Artificial Sequence
  Description of Artificial Sequence: Synthetic oligonucleotide
ttgacagcgacgtgggggagttccg

SEQ ID NO: 417341 - DNA, 24 bp, Artificial Sequence
  Description of Artificial Sequence: Synthetic oligonucleotide
tgacagcgacgtgggggagttccg

SEQ ID NO: 417342 - DNA, 23 bp, Artificial Sequence
  Description of Artificial Sequence: Synthetic oligonucleotide
tgggggagttccgggcggtgact

SEQ ID NO: 417343 - DNA, 22 bp, Artificial Sequence
  Description of Artificial Sequence: Synthetic oligonucleotide
gggggagttccgggcggtgact

SEQ ID NO: 417344 - DNA, 23 bp, Artificial Sequence
  Description of Artificial Sequence: Synthetic oligonucleotide
ggggagttccgggcggtgactga

SEQ ID NO: 417345 - DNA, 23 bp, Artificial Sequence
  Description of Artificial Sequence: Synthetic oligonucleotide
gggagttccgggcggtgactgag

SEQ ID NO: 417346 - DNA, 24 bp, Artificial Sequence
  Description of Artificial Sequence: Synthetic oligonucleotide
ggagttccgggcggtgactgagct

SEQ ID NO: 417347 - DNA, 24 bp, Artificial Sequence
  Description of Artificial Sequence: Synthetic oligonucleotide
gagttccgggcggtgactgagctg

SEQ ID NO: 417348 - DNA, 24 bp, Artificial Sequence
  Description of Artificial Sequence: Synthetic oligonucleotide
agttccgggcggtgactgagctgg

SEQ ID NO: 417349 - DNA, 23 bp, Artificial Sequence
  Description of Artificial Sequence: Synthetic oligonucleotide
gttccgggcggtgactgagctgg

SEQ ID NO: 417350 - DNA, 23 bp, Artificial Sequence
  Description of Artificial Sequence: Synthetic oligonucleotide
ttccgggcggtgactgagctggg

SEQ ID NO: 417351 - DNA, 22 bp, Artificial Sequence
  Description of Artificial Sequence: Synthetic oligonucleotide
tccgggcggtgactgagctggg

SEQ ID NO: 417352 - DNA, 21 bp, Artificial Sequence
  Description of Artificial Sequence: Synthetic oligonucleotide
ccgggcggtgactgagctggg

SEQ ID NO: 417353 - DNA, 21 bp, Artificial Sequence
  Description of Artificial Sequence: Synthetic oligonucleotide
cgggcggtgactgagctgggg

SEQ ID NO: 417354 - DNA, 21 bp, Artificial Sequence
  Description of Artificial Sequence: Synthetic oligonucleotide
gggcggtgactgagctggggc

SEQ ID NO: 417355 - DNA, 21 bp, Artificial Sequence
  Description of Artificial Sequence: Synthetic oligonucleotide
ggcggtgactgagctggggcg

SEQ ID NO: 417356 - DNA, 21 bp, Artificial Sequence
  Description of Artificial Sequence: Synthetic oligonucleotide
gcggtgactgagctggggcgg

SEQ ID NO: 417357 - DNA, 21 bp, Artificial Sequence
  Description of Artificial Sequence: Synthetic oligonucleotide
cggtgactgagctggggcggc

SEQ ID NO: 417358 - DNA, 22 bp, Artificial Sequence
  Description of Artificial Sequence: Synthetic oligonucleotide
ggtgactgagctggggcggcct

SEQ ID NO: 417359 - DNA, 24 bp, Artificial Sequence
  Description of Artificial Sequence: Synthetic oligonucleotide
gtgactgagctggggcggcctgat

SEQ ID NO: 417360 - DNA, 25 bp, Artificial Sequence
  Description of Artificial Sequence: Synthetic oligonucleotide
tgactgagctggggcggcctgatga

SEQ ID NO: 417361 - DNA, 24 bp, Artificial Sequence
  Description of Artificial Sequence: Synthetic oligonucleotide
gactgagctggggcggcctgatga

SEQ ID NO: 417362 - DNA, 24 bp, Artificial Sequence
  Description of Artificial Sequence: Synthetic oligonucleotide
actgagctggggcggcctgatgag

SEQ ID NO: 417363 - DNA, 23 bp, Artificial Sequence
  Description of Artificial Sequence: Synthetic oligonucleotide
ctgagctggggcggcctgatgag

SEQ ID NO: 417364 - DNA, 24 bp, Artificial Sequence
  Description of Artificial Sequence: Synthetic oligonucleotide
tgagctggggcggcctgatgagga

SEQ ID NO: 417365 - DNA, 23 bp, Artificial Sequence
  Description of Artificial Sequence: Synthetic oligonucleotide
ggggagttccgggcagtgacgga

SEQ ID NO: 417366 - DNA, 23 bp, Artificial Sequence
  Description of Artificial Sequence: Synthetic oligonucleotide
gggagttccgggcagtgacggag

SEQ ID NO: 417367 - DNA, 24 bp, Artificial Sequence
  Description of Artificial Sequence: Synthetic oligonucleotide
ggagttccgggcagtgacggagct

SEQ ID NO: 417368 - DNA, 24 bp, Artificial Sequence
  Description of Artificial Sequence: Synthetic oligonucleotide
gagttccgggcagtgacggagctg

SEQ ID NO: 417369 - DNA, 24 bp, Artificial Sequence
  Description of Artificial Sequence: Synthetic oligonucleotide
agttccgggcagtgacggagctgg

SEQ ID NO: 417370 - DNA, 23 bp, Artificial Sequence
  Description of Artificial Sequence: Synthetic oligonucleotide
gttccgggcagtgacggagctgg

SEQ ID NO: 417371 - DNA, 23 bp, Artificial Sequence
  Description of Artificial Sequence: Synthetic oligonucleotide
ttccgggcagtgacggagctggg

SEQ ID NO: 417372 - DNA, 22 bp, Artificial Sequence
  Description of Artificial Sequence: Synthetic oligonucleotide
tccgggcagtgacggagctggg

SEQ ID NO: 417373 - DNA, 29 bp, Artificial Sequence
  Description of Artificial Sequence: Synthetic oligonucleotide
gaacagccagaaggacttcctggaagacg

SEQ ID NO: 417374 - DNA, 30 bp, Artificial Sequence; identical to SEQ ID NO: 70104
  Description of Artificial Sequence: Synthetic oligonucleotide

SEQ ID NO: 417375 - DNA, 29 bp, Artificial Sequence
  Description of Artificial Sequence: Synthetic oligonucleotide
acagccagaaggacttcctggaagacgag

SEQ ID NO: 417376 - DNA, 28 bp, Artificial Sequence
  Description of Artificial Sequence: Synthetic oligonucleotide
cagccagaaggacttcctggaagacgag

SEQ ID NO: 417377 - DNA, 28 bp, Artificial Sequence
  Description of Artificial Sequence: Synthetic oligonucleotide
agccagaaggacttcctggaagacgagc

SEQ ID NO: 417378 - DNA, 27 bp, Artificial Sequence
  Description of Artificial Sequence: Synthetic oligonucleotide
gccagaaggacttcctggaagacgagc

SEQ ID NO: 417379 - DNA, 27 bp, Artificial Sequence
  Description of Artificial Sequence: Synthetic oligonucleotide
ccagaaggacttcctggaagacgagcg

SEQ ID NO: 417380 - DNA, 27 bp, Artificial Sequence
  Description of Artificial Sequence: Synthetic oligonucleotide
cagaaggacttcctggaagacgagcgg

SEQ ID NO: 417381 - DNA, 27 bp, Artificial Sequence
  Description of Artificial Sequence: Synthetic oligonucleotide
agaaggacttcctggaagacgagcggg

SEQ ID NO: 417382 - DNA, 26 bp, Artificial Sequence
  Description of Artificial Sequence: Synthetic oligonucleotide
gaaggacttcctggaagacgagcggg

SEQ ID NO: 417383 - DNA, 26 bp, Artificial Sequence
  Description of Artificial Sequence: Synthetic oligonucleotide
aaggacttcctggaagacgagcgggc

SEQ ID NO: 417384 - DNA, 25 bp, Artificial Sequence
  Description of Artificial Sequence: Synthetic oligonucleotide
aggacttcctggaagacgagcgggc

SEQ ID NO: 417385 - DNA, 24 bp, Artificial Sequence
  Description of Artificial Sequence: Synthetic oligonucleotide
ggacttcctggaagacgagcgggc

SEQ ID NO: 417386 - DNA, 24 bp, Artificial Sequence
  Description of Artificial Sequence: Synthetic oligonucleotide
gacttcctggaagacgagcgggcc

SEQ ID NO: 417387 - DNA, 24 bp, Artificial Sequence
  Description of Artificial Sequence: Synthetic oligonucleotide
acttcctggaagacgagcgggccg

SEQ ID NO: 417388 - DNA, 23 bp, Artificial Sequence
  Description of Artificial Sequence: Synthetic oligonucleotide
cttcctggaagacgagcgggccg

SEQ ID NO: 417389 - DNA, 23 bp, Artificial Sequence
  Description of Artificial Sequence: Synthetic oligonucleotide
ttcctggaagacgagcgggccgc

SEQ ID NO: 417390 - DNA, 29 bp, Artificial Sequence
  Description of Artificial Sequence: Synthetic oligonucleotide
gggtgcggttcctggacagatacttctac

SEQ ID NO: 417391 - DNA, 31 bp, Artificial Sequence; identical to SEQ ID NO: 72713
  Description of Artificial Sequence: Synthetic oligonucleotide

SEQ ID NO: 417392 - DNA, 31 bp, Artificial Sequence; identical to SEQ ID NO: 72714
  Description of Artificial Sequence: Synthetic oligonucleotide

SEQ ID NO: 417393 - DNA, 33 bp, Artificial Sequence
  Description of Artificial Sequence: Synthetic oligonucleotide
tgcggttcctggacagatacttctacaaccaag

SEQ ID NO: 417394 - DNA, 32 bp, Artificial Sequence
  Description of Artificial Sequence: Synthetic oligonucleotide
gcggttcctggacagatacttctacaaccaag

SEQ ID NO: 417395 - DNA, 33 bp, Artificial Sequence
  Description of Artificial Sequence: Synthetic oligonucleotide
cggttcctggacagatacttctacaaccaagag

SEQ ID NO: 417396 - DNA, 33 bp, Artificial Sequence
  Description of Artificial Sequence: Synthetic oligonucleotide
ggttcctggacagatacttctacaaccaagagg

SEQ ID NO: 417397 - DNA, 34 bp, Artificial Sequence
  Description of Artificial Sequence: Synthetic oligonucleotide
gttcctggacagatacttctacaaccaagaggag

SEQ ID NO: 417398 - DNA, 36 bp, Artificial Sequence
  Description of Artificial Sequence: Synthetic oligonucleotide
ttcctggacagatacttctacaaccaagaggagtac

SEQ ID NO: 417399 - DNA, 35 bp, Artificial Sequence
  Description of Artificial Sequence: Synthetic oligonucleotide
tcctggacagatacttctacaaccaagaggagtac

SEQ ID NO: 417400 - DNA, 34 bp, Artificial Sequence
  Description of Artificial Sequence: Synthetic oligonucleotide
cctggacagatacttctacaaccaagaggagtac

SEQ ID NO: 417401 - DNA, 34 bp, Artificial Sequence
  Description of Artificial Sequence: Synthetic oligonucleotide
ctggacagatacttctacaaccaagaggagtacg

SEQ ID NO: 417402 - DNA, 35 bp, Artificial Sequence
  Description of Artificial Sequence: Synthetic oligonucleotide
tggacagatacttctacaaccaagaggagtacgtg

SEQ ID NO: 417403 - DNA, 34 bp, Artificial Sequence
  Description of Artificial Sequence: Synthetic oligonucleotide
ggacagatacttctacaaccaagaggagtacgtg

SEQ ID NO: 417404 - DNA, 34 bp, Artificial Sequence
  Description of Artificial Sequence: Synthetic oligonucleotide
gacagatacttctacaaccaagaggagtacgtgc

SEQ ID NO: 417405 - DNA, 34 bp, Artificial Sequence
  Description of Artificial Sequence: Synthetic oligonucleotide
acagatacttctacaaccaagaggagtacgtgcg

SEQ ID NO: 417406 - DNA, 33 bp, Artificial Sequence
  Description of Artificial Sequence: Synthetic oligonucleotide
cagatacttctacaaccaagaggagtacgtgcg

SEQ ID NO: 417407 - DNA, 33 bp, Artificial Sequence
  Description of Artificial Sequence: Synthetic oligonucleotide
agatacttctacaaccaagaggagtacgtgcgc

SEQ ID NO: 417408 - DNA, 32 bp, Artificial Sequence
  Description of Artificial Sequence: Synthetic oligonucleotide
gatacttctacaaccaagaggagtacgtgcgc

SEQ ID NO: 417409 - DNA, 34 bp, Artificial Sequence
  Description of Artificial Sequence: Synthetic oligonucleotide
atacttctacaaccaagaggagtacgtgcgcttc

SEQ ID NO: 417410 - DNA, 33 bp, Artificial Sequence
  Description of Artificial Sequence: Synthetic oligonucleotide
tacttctacaaccaagaggagtacgtgcgcttc

SEQ ID NO: 417411 - DNA, 32 bp, Artificial Sequence
  Description of Artificial Sequence: Synthetic oligonucleotide
acttctacaaccaagaggagtacgtgcgcttc

SEQ ID NO: 417412 - DNA, 31 bp, Artificial Sequence
  Description of Artificial Sequence: Synthetic oligonucleotide
cttctacaaccaagaggagtacgtgcgcttc

SEQ ID NO: 417413 - DNA, 31 bp, Artificial Sequence
  Description of Artificial Sequence: Synthetic oligonucleotide
ttctacaaccaagaggagtacgtgcgcttcg

SEQ ID NO: 417414 - DNA, 30 bp, Artificial Sequence
  Description of Artificial Sequence: Synthetic oligonucleotide
tctacaaccaagaggagtacgtgcgcttcg

SEQ ID NO: 417415 - DNA, 29 bp, Artificial Sequence
  Description of Artificial Sequence: Synthetic oligonucleotide
ctacaaccaagaggagtacgtgcgcttcg

SEQ ID NO: 417416 - DNA, 30 bp, Artificial Sequence
  Description of Artificial Sequence: Synthetic oligonucleotide
tacaaccaagaggagtacgtgcgcttcgac

SEQ ID NO: 417417 - DNA, 29 bp, Artificial Sequence
  Description of Artificial Sequence: Synthetic oligonucleotide
acaaccaagaggagtacgtgcgcttcgac

SEQ ID NO: 417418 - DNA, 28 bp, Artificial Sequence
  Description of Artificial Sequence: Synthetic oligonucleotide
caaccaagaggagtacgtgcgcttcgac

SEQ ID NO: 417419 - DNA, 32 bp, Artificial Sequence; identical to SEQ ID NO: 70153
  Description of Artificial Sequence: Synthetic oligonucleotide

SEQ ID NO: 417420 - DNA, 31 bp, Artificial Sequence; identical to SEQ ID NO: 70154
  Description of Artificial Sequence: Synthetic oligonucleotide

SEQ ID NO: 417421 - DNA, 35 bp, Artificial Sequence; identical to SEQ ID NO: 70155
  Description of Artificial Sequence: Synthetic oligonucleotide

SEQ ID NO: 417422 - DNA, 37 bp, Artificial Sequence; identical to SEQ ID NO: 70156
  Description of Artificial Sequence: Synthetic oligonucleotide

SEQ ID NO: 417423 - DNA, 36 bp, Artificial Sequence; identical to SEQ ID NO: 70157
  Description of Artificial Sequence: Synthetic oligonucleotide

SEQ ID NO: 417424 - DNA, 35 bp, Artificial Sequence; identical to SEQ ID NO: 70158
  Description of Artificial Sequence: Synthetic oligonucleotide

SEQ ID NO: 417425 - DNA, 34 bp, Artificial Sequence; identical to SEQ ID NO: 70159
  Description of Artificial Sequence: Synthetic oligonucleotide

SEQ ID NO: 417426 - DNA, 37 bp, Artificial Sequence; identical to SEQ ID NO: 70160
  Description of Artificial Sequence: Synthetic oligonucleotide

SEQ ID NO: 417427 - DNA, 36 bp, Artificial Sequence; identical to SEQ ID NO: 70161
  Description of Artificial Sequence: Synthetic oligonucleotide

SEQ ID NO: 417428 - DNA, 35 bp, Artificial Sequence; identical to SEQ ID NO: 70162
  Description of Artificial Sequence: Synthetic oligonucleotide

SEQ ID NO: 417429 - DNA, 35 bp, Artificial Sequence; identical to SEQ ID NO: 70163
  Description of Artificial Sequence: Synthetic oligonucleotide

SEQ ID NO: 417430 - DNA, 35 bp, Artificial Sequence; identical to SEQ ID NO: 70164
  Description of Artificial Sequence: Synthetic oligonucleotide

SEQ ID NO: 417431 - DNA, 34 bp, Artificial Sequence; identical to SEQ ID NO: 70165
  Description of Artificial Sequence: Synthetic oligonucleotide

SEQ ID NO: 417432 - DNA, 35 bp, Artificial Sequence; identical to SEQ ID NO: 70166
  Description of Artificial Sequence: Synthetic oligonucleotide

SEQ ID NO: 417433 - DNA, 34 bp, Artificial Sequence; identical to SEQ ID NO: 70167
  Description of Artificial Sequence: Synthetic oligonucleotide

SEQ ID NO: 417434 - DNA, 33 bp, Artificial Sequence; identical to SEQ ID NO: 70168
  Description of Artificial Sequence: Synthetic oligonucleotide

SEQ ID NO: 417435 - DNA, 33 bp, Artificial Sequence; identical to SEQ ID NO: 70169
  Description of Artificial Sequence: Synthetic oligonucleotide

SEQ ID NO: 417436 - DNA, 32 bp, Artificial Sequence; identical to SEQ ID NO: 70170
  Description of Artificial Sequence: Synthetic oligonucleotide

SEQ ID NO: 417437 - DNA, 32 bp, Artificial Sequence; identical to SEQ ID NO: 70171
  Description of Artificial Sequence: Synthetic oligonucleotide

SEQ ID NO: 417438 - DNA, 31 bp, Artificial Sequence; identical to SEQ ID NO: 70172
  Description of Artificial Sequence: Synthetic oligonucleotide

SEQ ID NO: 417439 - DNA, 30 bp, Artificial Sequence; identical to SEQ ID NO: 70173
  Description of Artificial Sequence: Synthetic oligonucleotide

SEQ ID NO: 417440 - DNA, 31 bp, Artificial Sequence; identical to SEQ ID NO: 70174
  Description of Artificial Sequence: Synthetic oligonucleotide

SEQ ID NO: 417441 - DNA, 31 bp, Artificial Sequence; identical to SEQ ID NO: 70175
  Description of Artificial Sequence: Synthetic oligonucleotide

SEQ ID NO: 417442 - DNA, 31 bp, Artificial Sequence; identical to SEQ ID NO: 70176
  Description of Artificial Sequence: Synthetic oligonucleotide

SEQ ID NO: 417443 - DNA, 22 bp, Artificial Sequence
  Description of Artificial Sequence: Synthetic oligonucleotide
ctcctggaagacaggcgggccg

SEQ ID NO: 417444 - DNA, 28 bp, Artificial Sequence
  Description of Artificial Sequence: Synthetic oligonucleotide
ggttggtgagagcttcacagtgcagcag

SEQ ID NO: 417445 - DNA, 28 bp, Artificial Sequence
  Description of Artificial Sequence: Synthetic oligonucleotide
gttggtgagagcttcacagtgcagcagc

SEQ ID NO: 417446 - DNA, 28 bp, Artificial Sequence
  Description of Artificial Sequence: Synthetic oligonucleotide
ttggtgagagcttcacagtgcagcagcg

SEQ ID NO: 417447 - DNA, 27 bp, Artificial Sequence
  Description of Artificial Sequence: Synthetic oligonucleotide
tggtgagagcttcacagtgcagcagcg

SEQ ID NO: 417448 - DNA, 27 bp, Artificial Sequence
  Description of Artificial Sequence: Synthetic oligonucleotide
ggtgagagcttcacagtgcagcagcga

SEQ ID NO: 417449 - DNA, 27 bp, Artificial Sequence
  Description of Artificial Sequence: Synthetic oligonucleotide
gtgagagcttcacagtgcagcagcgag

SEQ ID NO: 417450 - DNA, 29 bp, Artificial Sequence
  Description of Artificial Sequence: Synthetic oligonucleotide
ggtggacacctactgcagacacaactacc

SEQ ID NO: 417451 - DNA, 29 bp, Artificial Sequence
  Description of Artificial Sequence: Synthetic oligonucleotide
gtggacacctactgcagacacaactaccg

SEQ ID NO: 417452 - DNA, 29 bp, Artificial Sequence
  Description of Artificial Sequence: Synthetic oligonucleotide
tggacacctactgcagacacaactaccgg

SEQ ID NO: 417453 - DNA, 28 bp, Artificial Sequence
  Description of Artificial Sequence: Synthetic oligonucleotide
ggacacctactgcagacacaactaccgg

SEQ ID NO: 417454 - DNA, 28 bp, Artificial Sequence
  Description of Artificial Sequence: Synthetic oligonucleotide
gacacctactgcagacacaactaccggg

SEQ ID NO: 417455 - DNA, 30 bp, Artificial Sequence; identical to SEQ ID NO: 71497
  Description of Artificial Sequence: Synthetic oligonucleotide

SEQ ID NO: 417456 - DNA, 29 bp, Artificial Sequence
  Description of Artificial Sequence: Synthetic oligonucleotide
cacctactgcagacacaactaccgggttg

SEQ ID NO: 417457 - DNA, 29 bp, Artificial Sequence
  Description of Artificial Sequence: Synthetic oligonucleotide
acctactgcagacacaactaccgggttgg

SEQ ID NO: 417458 - DNA, 28 bp, Artificial Sequence
  Description of Artificial Sequence: Synthetic oligonucleotide
cctactgcagacacaactaccgggttgg

SEQ ID NO: 417459 - DNA, 29 bp, Artificial Sequence
  Description of Artificial Sequence: Synthetic oligonucleotide
ctactgcagacacaactaccgggttggtg

SEQ ID NO: 417460 - DNA, 30 bp, Artificial Sequence; identical to SEQ ID NO: 74055
  Description of Artificial Sequence: Synthetic oligonucleotide

SEQ ID NO: 417461 - DNA, 29 bp, Artificial Sequence
  Description of Artificial Sequence: Synthetic oligonucleotide
actgcagacacaactaccgggttggtgag

SEQ ID NO: 417462 - DNA, 28 bp, Artificial Sequence
  Description of Artificial Sequence: Synthetic oligonucleotide
ctgcagacacaactaccgggttggtgag

SEQ ID NO: 417463 - DNA, 29 bp, Artificial Sequence
  Description of Artificial Sequence: Synthetic oligonucleotide
tgcagacacaactaccgggttggtgagag

SEQ ID NO: 417464 - DNA, 28 bp, Artificial Sequence
  Description of Artificial Sequence: Synthetic oligonucleotide
gcagacacaactaccgggttggtgagag

SEQ ID NO: 417465 - DNA, 28 bp, Artificial Sequence
  Description of Artificial Sequence: Synthetic oligonucleotide
cagacacaactaccgggttggtgagagc

SEQ ID NO: 417466 - DNA, 30 bp, Artificial Sequence; identical to SEQ ID NO: 74061
  Description of Artificial Sequence: Synthetic oligonucleotide

SEQ ID NO: 417467 - DNA, 29 bp, Artificial Sequence
  Description of Artificial Sequence: Synthetic oligonucleotide
gacacaactaccgggttggtgagagcttc

SEQ ID NO: 417468 - DNA, 30 bp, Artificial Sequence; identical to SEQ ID NO: 74063
  Description of Artificial Sequence: Synthetic oligonucleotide

SEQ ID NO: 417469 - DNA, 29 bp, Artificial Sequence
  Description of Artificial Sequence: Synthetic oligonucleotide
cacaactaccgggttggtgagagcttcac

SEQ ID NO: 417470 - DNA, 30 bp, Artificial Sequence; identical to SEQ ID NO: 74065
  Description of Artificial Sequence: Synthetic oligonucleotide

SEQ ID NO: 417471 - DNA, 29 bp, Artificial Sequence
  Description of Artificial Sequence: Synthetic oligonucleotide
caactaccgggttggtgagagcttcacag

SEQ ID NO: 417472 - DNA, 30 bp, Artificial Sequence; identical to SEQ ID NO: 74067
  Description of Artificial Sequence: Synthetic oligonucleotide

SEQ ID NO: 417473 - DNA, 29 bp, Artificial Sequence
  Description of Artificial Sequence: Synthetic oligonucleotide
actaccgggttggtgagagcttcacagtg

SEQ ID NO: 417474 - DNA, 28 bp, Artificial Sequence
  Description of Artificial Sequence: Synthetic oligonucleotide
ctaccgggttggtgagagcttcacagtg

SEQ ID NO: 417475 - DNA, 28 bp, Artificial Sequence
  Description of Artificial Sequence: Synthetic oligonucleotide
taccgggttggtgagagcttcacagtgc

SEQ ID NO: 417476 - DNA, 27 bp, Artificial Sequence
  Description of Artificial Sequence: Synthetic oligonucleotide
accgggttggtgagagcttcacagtgc

SEQ ID NO: 417477 - DNA, 27 bp, Artificial Sequence
  Description of Artificial Sequence: Synthetic oligonucleotide
ccgggttggtgagagcttcacagtgca

SEQ ID NO: 417478 - DNA, 27 bp, Artificial Sequence
  Description of Artificial Sequence: Synthetic oligonucleotide
cgggttggtgagagcttcacagtgcag

SEQ ID NO: 417479 - DNA, 38 bp, Artificial Sequence
  Description of Artificial Sequence: Synthetic oligonucleotide
cacgtttcttggagtactttacgtctgagtgtcatttc

SEQ ID NO: 417480 - DNA, 40 bp, Artificial Sequence
  Description of Artificial Sequence: Synthetic oligonucleotide
acgtttcttggagtactttacgtctgagtgtcatttcttc

SEQ ID NO: 417481 - DNA, 39 bp, Artificial Sequence
  Description of Artificial Sequence: Synthetic oligonucleotide
cgtttcttggagtactttacgtctgagtgtcatttcttc

SEQ ID NO: 417482 - DNA, 42 bp, Artificial Sequence
  Description of Artificial Sequence: Synthetic oligonucleotide
gtttcttggagtactttacgtctgagtgtcatttcttcaatg

SEQ ID NO: 417483 - DNA, 42 bp, Artificial Sequence
  Description of Artificial Sequence: Synthetic oligonucleotide
tttcttggagtactttacgtctgagtgtcatttcttcaatgg

SEQ ID NO: 417484 - DNA, 41 bp, Artificial Sequence
  Description of Artificial Sequence: Synthetic oligonucleotide
ttcttggagtactttacgtctgagtgtcatttcttcaatgg

SEQ ID NO: 417485 - DNA, 40 bp, Artificial Sequence
  Description of Artificial Sequence: Synthetic oligonucleotide
tcttggagtactttacgtctgagtgtcatttcttcaatgg

SEQ ID NO: 417486 - DNA, 39 bp, Artificial Sequence
  Description of Artificial Sequence: Synthetic oligonucleotide
cttggagtactttacgtctgagtgtcatttcttcaatgg

SEQ ID NO: 417487 - DNA, 39 bp, Artificial Sequence
  Description of Artificial Sequence: Synthetic oligonucleotide
ttggagtactttacgtctgagtgtcatttcttcaatggg

SEQ ID NO: 417488 - DNA, 38 bp, Artificial Sequence
  Description of Artificial Sequence: Synthetic oligonucleotide
tggagtactttacgtctgagtgtcatttcttcaatggg

SEQ ID NO: 417489 - DNA, 37 bp, Artificial Sequence
  Description of Artificial Sequence: Synthetic oligonucleotide
ggagtactttacgtctgagtgtcatttcttcaatggg

SEQ ID NO: 417490 - DNA, 38 bp, Artificial Sequence
  Description of Artificial Sequence: Synthetic oligonucleotide
gagtactttacgtctgagtgtcatttcttcaatgggac

SEQ ID NO: 417491 - DNA, 38 bp, Artificial Sequence
  Description of Artificial Sequence: Synthetic oligonucleotide
agtactttacgtctgagtgtcatttcttcaatgggacg

SEQ ID NO: 417492 - DNA, 37 bp, Artificial Sequence
  Description of Artificial Sequence: Synthetic oligonucleotide
gtactttacgtctgagtgtcatttcttcaatgggacg

SEQ ID NO: 417493 - DNA, 37 bp, Artificial Sequence
  Description of Artificial Sequence: Synthetic oligonucleotide
tactttacgtctgagtgtcatttcttcaatgggacgg

SEQ ID NO: 417494 - DNA, 36 bp, Artificial Sequence
  Description of Artificial Sequence: Synthetic oligonucleotide
actttacgtctgagtgtcatttcttcaatgggacgg

SEQ ID NO: 417495 - DNA, 35 bp, Artificial Sequence
  Description of Artificial Sequence: Synthetic oligonucleotide
ctttacgtctgagtgtcatttcttcaatgggacgg

SEQ ID NO: 417496 - DNA, 36 bp, Artificial Sequence
  Description of Artificial Sequence: Synthetic oligonucleotide
tttacgtctgagtgtcatttcttcaatgggacggag

SEQ ID NO: 417497 - DNA, 35 bp, Artificial Sequence
  Description of Artificial Sequence: Synthetic oligonucleotide
ttacgtctgagtgtcatttcttcaatgggacggag

SEQ ID NO: 417498 - DNA, 33 bp, Artificial Sequence
  Description of Artificial Sequence: Synthetic oligonucleotide
tctgagtgtcatttcttcaatgggacggagcag

SEQ ID NO: 417499 - DNA, 32 bp, Artificial Sequence
  Description of Artificial Sequence: Synthetic oligonucleotide
ctgagtgtcatttcttcaatgggacggagcag

SEQ ID NO: 417500 - DNA, 32 bp, Artificial Sequence
  Description of Artificial Sequence: Synthetic oligonucleotide
tgagtgtcatttcttcaatgggacggagcagg

SEQ ID NO: 417501 - DNA, 31 bp, Artificial Sequence; identical to SEQ ID NO: 73353
  Description of Artificial Sequence: Synthetic oligonucleotide

SEQ ID NO: 417502 - DNA, 32 bp, Artificial Sequence; identical to SEQ ID NO: 73354
  Description of Artificial Sequence: Synthetic oligonucleotide

SEQ ID NO: 417503 - DNA, 31 bp, Artificial Sequence; identical to SEQ ID NO: 73355
  Description of Artificial Sequence: Synthetic oligonucleotide

SEQ ID NO: 417504 - DNA, 31 bp, Artificial Sequence; identical to SEQ ID NO: 73356
  Description of Artificial Sequence: Synthetic oligonucleotide

SEQ ID NO: 417505 - DNA, 30 bp, Artificial Sequence; identical to SEQ ID NO: 73357
  Description of Artificial Sequence: Synthetic oligonucleotide

SEQ ID NO: 417506 - DNA, 30 bp, Artificial Sequence; identical to SEQ ID NO: 73358
  Description of Artificial Sequence: Synthetic oligonucleotide

SEQ ID NO: 417507 - DNA, 29 bp, Artificial Sequence
  Description of Artificial Sequence: Synthetic oligonucleotide
catttcttcaatgggacggagcaggtgcg

SEQ ID NO: 417508 - DNA, 29 bp, Artificial Sequence
  Description of Artificial Sequence: Synthetic oligonucleotide
atttcttcaatgggacggagcaggtgcgg

SEQ ID NO: 417509 - DNA, 28 bp, Artificial Sequence
  Description of Artificial Sequence: Synthetic oligonucleotide
tttcttcaatgggacggagcaggtgcgg

SEQ ID NO: 417510 - DNA, 27 bp, Artificial Sequence
  Description of Artificial Sequence: Synthetic oligonucleotide
ttcttcaatgggacggagcaggtgcgg

SEQ ID NO: 417511 - DNA, 27 bp, Artificial Sequence
  Description of Artificial Sequence: Synthetic oligonucleotide
tcttcaatgggacggagcaggtgcggt

SEQ ID NO: 417512 - DNA, 27 bp, Artificial Sequence
  Description of Artificial Sequence: Synthetic oligonucleotide
cttcaatgggacggagcaggtgcggtt

SEQ ID NO: 417513 - DNA, 27 bp, Artificial Sequence
  Description of Artificial Sequence: Synthetic oligonucleotide
ttcaatgggacggagcaggtgcggttc

SEQ ID NO: 417514 - DNA, 26 bp, Artificial Sequence
  Description of Artificial Sequence: Synthetic oligonucleotide
tcaatgggacggagcaggtgcggttc

SEQ ID NO: 417515 - DNA, 25 bp, Artificial Sequence
  Description of Artificial Sequence: Synthetic oligonucleotide
caatgggacggagcaggtgcggttc

SEQ ID NO: 417516 - DNA, 26 bp, Artificial Sequence
  Description of Artificial Sequence: Synthetic oligonucleotide
aatgggacggagcaggtgcggttcct

SEQ ID NO: 417517 - DNA, 25 bp, Artificial Sequence
  Description of Artificial Sequence: Synthetic oligonucleotide
atgggacggagcaggtgcggttcct

SEQ ID NO: 417518 - DNA, 24 bp, Artificial Sequence
  Description of Artificial Sequence: Synthetic oligonucleotide
tgggacggagcaggtgcggttcct

SEQ ID NO: 417519 - DNA, 23 bp, Artificial Sequence
  Description of Artificial Sequence: Synthetic oligonucleotide
gggacggagcaggtgcggttcct

SEQ ID NO: 417520 - DNA, 23 bp, Artificial Sequence
  Description of Artificial Sequence: Synthetic oligonucleotide
ggacggagcaggtgcggttcctg

SEQ ID NO: 417521 - DNA, 24 bp, Artificial Sequence
  Description of Artificial Sequence: Synthetic oligonucleotide
gacggagcaggtgcggttcctgga

SEQ ID NO: 417522 - DNA, 25 bp, Artificial Sequence
  Description of Artificial Sequence: Synthetic oligonucleotide
acggagcaggtgcggttcctggaca

SEQ ID NO: 417523 - DNA, 24 bp, Artificial Sequence
  Description of Artificial Sequence: Synthetic oligonucleotide
cggagcaggtgcggttcctggaca

SEQ ID NO: 417524 - DNA, 27 bp, Artificial Sequence
  Description of Artificial Sequence: Synthetic oligonucleotide
ggagcaggtgcggttcctggacagata

SEQ ID NO: 417525 - DNA, 27 bp, Artificial Sequence
  Description of Artificial Sequence: Synthetic oligonucleotide
gagcaggtgcggttcctggacagatac

SEQ ID NO: 417526 - DNA, 29 bp, Artificial Sequence
  Description of Artificial Sequence: Synthetic oligonucleotide
agcaggtgcggttcctggacagatacttc

SEQ ID NO: 417527 - DNA, 28 bp, Artificial Sequence
  Description of Artificial Sequence: Synthetic oligonucleotide
gcaggtgcggttcctggacagatacttc

SEQ ID NO: 417528 - DNA, 33 bp, Artificial Sequence; identical to SEQ ID NO: 73380
  Description of Artificial Sequence: Synthetic oligonucleotide

SEQ ID NO: 417529 - DNA, 33 bp, Artificial Sequence; identical to SEQ ID NO: 73381
  Description of Artificial Sequence: Synthetic oligonucleotide

SEQ ID NO: 417530 - DNA, 23 bp, Artificial Sequence
  Description of Artificial Sequence: Synthetic oligonucleotide
agcgacgtgggggagttccggga

SEQ ID NO: 417531 - DNA, 22 bp, Artificial Sequence
  Description of Artificial Sequence: Synthetic oligonucleotide
gcgacgtgggggagttccggga

SEQ ID NO: 417532 - DNA, 22 bp, Artificial Sequence
  Description of Artificial Sequence: Synthetic oligonucleotide
cgacgtgggggagttccgggag

SEQ ID NO: 417533 - DNA, 23 bp, Artificial Sequence
  Description of Artificial Sequence: Synthetic oligonucleotide
gacgtgggggagttccgggaggt

SEQ ID NO: 417534 - DNA, 24 bp, Artificial Sequence
  Description of Artificial Sequence: Synthetic oligonucleotide
acgtgggggagttccgggaggtga

SEQ ID NO: 417535 - DNA, 23 bp, Artificial Sequence
  Description of Artificial Sequence: Synthetic oligonucleotide
cgtgggggagttccgggaggtga

SEQ ID NO: 417536 - DNA, 23 bp, Artificial Sequence
  Description of Artificial Sequence: Synthetic oligonucleotide
gtgggggagttccgggaggtgac

SEQ ID NO: 417537 - DNA, 23 bp, Artificial Sequence
  Description of Artificial Sequence: Synthetic oligonucleotide
tgggggagttccgggaggtgacg

SEQ ID NO: 417538 - DNA, 22 bp, Artificial Sequence
  Description of Artificial Sequence: Synthetic oligonucleotide
gggggagttccgggaggtgacg

SEQ ID NO: 417539 - DNA, 23 bp, Artificial Sequence
  Description of Artificial Sequence: Synthetic oligonucleotide
ggggagttccgggaggtgacgga

SEQ ID NO: 417540 - DNA, 23 bp, Artificial Sequence
  Description of Artificial Sequence: Synthetic oligonucleotide
gggagttccgggaggtgacggag

SEQ ID NO: 417541 - DNA, 24 bp, Artificial Sequence
  Description of Artificial Sequence: Synthetic oligonucleotide
ggagttccgggaggtgacggagct

SEQ ID NO: 417542 - DNA, 24 bp, Artificial Sequence
  Description of Artificial Sequence: Synthetic oligonucleotide
gagttccgggaggtgacggagctg

SEQ ID NO: 417543 - DNA, 24 bp, Artificial Sequence
  Description of Artificial Sequence: Synthetic oligonucleotide
agttccgggaggtgacggagctgg

SEQ ID NO: 417544 - DNA, 23 bp, Artificial Sequence
  Description of Artificial Sequence: Synthetic oligonucleotide
gttccgggaggtgacggagctgg

SEQ ID NO: 417545 - DNA, 23 bp, Artificial Sequence
  Description of Artificial Sequence: Synthetic oligonucleotide
ttccgggaggtgacggagctggg

SEQ ID NO: 417546 - DNA, 22 bp, Artificial Sequence
  Description of Artificial Sequence: Synthetic oligonucleotide
tccgggaggtgacggagctggg

SEQ ID NO: 417547 - DNA, 21 bp, Artificial Sequence
  Description of Artificial Sequence: Synthetic oligonucleotide
ccgggaggtgacggagctggg

SEQ ID NO: 417548 - DNA, 21 bp, Artificial Sequence
  Description of Artificial Sequence: Synthetic oligonucleotide
cgggaggtgacggagctgggg

SEQ ID NO: 417549 - DNA, 21 bp, Artificial Sequence
  Description of Artificial Sequence: Synthetic oligonucleotide
gggaggtgacggagctggggc

SEQ ID NO: 417550 - DNA, 21 bp, Artificial Sequence
  Description of Artificial Sequence: Synthetic oligonucleotide
ggaggtgacggagctggggcg

SEQ ID NO: 417551 - DNA, 21 bp, Artificial Sequence
  Description of Artificial Sequence: Synthetic oligonucleotide
gaggtgacggagctggggcgg

SEQ ID NO: 417552 - DNA, 21 bp, Artificial Sequence
  Description of Artificial Sequence: Synthetic oligonucleotide
aggtgacggagctggggcggc

SEQ ID NO: 417553 - DNA, 24 bp, Artificial Sequence
  Description of Artificial Sequence: Synthetic oligonucleotide
gtgacggagctggggcggcctaat

SEQ ID NO: 417554 - DNA, 25 bp, Artificial Sequence
  Description of Artificial Sequence: Synthetic oligonucleotide
tgacggagctggggcggcctaatga

SEQ ID NO: 417555 - DNA, 24 bp, Artificial Sequence
  Description of Artificial Sequence: Synthetic oligonucleotide
gacggagctggggcggcctaatga

SEQ ID NO: 417556 - DNA, 24 bp, Artificial Sequence
  Description of Artificial Sequence: Synthetic oligonucleotide
acggagctggggcggcctaatgag

SEQ ID NO: 417557 - DNA, 23 bp, Artificial Sequence
  Description of Artificial Sequence: Synthetic oligonucleotide
cggagctggggcggcctaatgag

SEQ ID NO: 417558 - DNA, 24 bp, Artificial Sequence
  Description of Artificial Sequence: Synthetic oligonucleotide
ggagctggggcggcctaatgagga

SEQ ID NO: 417559 - DNA, 26 bp, Artificial Sequence
  Description of Artificial Sequence: Synthetic oligonucleotide
gagctggggcggcctaatgaggagta

SEQ ID NO: 417560 - DNA, 27 bp, Artificial Sequence
  Description of Artificial Sequence: Synthetic oligonucleotide
agctggggcggcctaatgaggagtact

SEQ ID NO: 417561 - DNA, 26 bp, Artificial Sequence
  Description of Artificial Sequence: Synthetic oligonucleotide
gctggggcggcctaatgaggagtact

SEQ ID NO: 417562 - DNA, 26 bp, Artificial Sequence
  Description of Artificial Sequence: Synthetic oligonucleotide
ctggggcggcctaatgaggagtactg

SEQ ID NO: 417563 - DNA, 27 bp, Artificial Sequence
  Description of Artificial Sequence: Synthetic oligonucleotide
tggggcggcctaatgaggagtactgga

SEQ ID NO: 417564 - DNA, 27 bp, Artificial Sequence
  Description of Artificial Sequence: Synthetic oligonucleotide
ggggcggcctaatgaggagtactggaa

SEQ ID NO: 417565 - DNA, 27 bp, Artificial Sequence
  Description of Artificial Sequence: Synthetic oligonucleotide
gggcggcctaatgaggagtactggaac

SEQ ID NO: 417566 - DNA, 28 bp, Artificial Sequence
  Description of Artificial Sequence: Synthetic oligonucleotide
ggcggcctaatgaggagtactggaacag

SEQ ID NO: 417567 - DNA, 28 bp, Artificial Sequence
  Description of Artificial Sequence: Synthetic oligonucleotide
gcggcctaatgaggagtactggaacagc

SEQ ID NO: 417568 - DNA, 28 bp, Artificial Sequence
  Description of Artificial Sequence: Synthetic oligonucleotide
cggcctaatgaggagtactggaacagcc

SEQ ID NO: 417569 - DNA, 29 bp, Artificial Sequence
  Description of Artificial Sequence: Synthetic oligonucleotide
ggcctaatgaggagtactggaacagccag

SEQ ID NO: 417570 - DNA, 31 bp, Artificial Sequence
  Description of Artificial Sequence: Synthetic oligonucleotide
gcctaatgaggagtactggaacagccagaag

SEQ ID NO: 417571 - DNA, 31 bp, Artificial Sequence
  Description of Artificial Sequence: Synthetic oligonucleotide
cctaatgaggagtactggaacagccagaagg

SEQ ID NO: 417572 - DNA, 32 bp, Artificial Sequence
  Description of Artificial Sequence: Synthetic oligonucleotide
ctaatgaggagtactggaacagccagaaggac

SEQ ID NO: 417573 - DNA, 34 bp, Artificial Sequence
  Description of Artificial Sequence: Synthetic oligonucleotide
taatgaggagtactggaacagccagaaggacttc

SEQ ID NO: 417574 - DNA, 33 bp, Artificial Sequence
  Description of Artificial Sequence: Synthetic oligonucleotide
aatgaggagtactggaacagccagaaggacttc

SEQ ID NO: 417575 - DNA, 32 bp, Artificial Sequence
  Description of Artificial Sequence: Synthetic oligonucleotide
ctgatgaggagtactggaacagccagaagaac

SEQ ID NO: 417576 - DNA, 34 bp, Artificial Sequence
  Description of Artificial Sequence: Synthetic oligonucleotide
tgatgaggagtactggaacagccagaagaacttc

SEQ ID NO: 417577 - DNA, 33 bp, Artificial Sequence
  Description of Artificial Sequence: Synthetic oligonucleotide
gatgaggagtactggaacagccagaagaacttc

SEQ ID NO: 417578 - DNA, 33 bp, Artificial Sequence
  Description of Artificial Sequence: Synthetic oligonucleotide
atgaggagtactggaacagccagaagaacttcc

SEQ ID NO: 417579 - DNA, 32 bp, Artificial Sequence
  Description of Artificial Sequence: Synthetic oligonucleotide
tgaggagtactggaacagccagaagaacttcc

SEQ ID NO: 417580 - DNA, 31 bp, Artificial Sequence
  Description of Artificial Sequence: Synthetic oligonucleotide
gaggagtactggaacagccagaagaacttcc

SEQ ID NO: 417581 - DNA, 32 bp, Artificial Sequence
  Description of Artificial Sequence: Synthetic oligonucleotide
aggagtactggaacagccagaagaacttcctg

SEQ ID NO: 417582 - DNA, 31 bp, Artificial Sequence
  Description of Artificial Sequence: Synthetic oligonucleotide
ggagtactggaacagccagaagaacttcctg

SEQ ID NO: 417583 - DNA, 31 bp, Artificial Sequence
  Description of Artificial Sequence: Synthetic oligonucleotide
gagtactggaacagccagaagaacttcctgg

SEQ ID NO: 417584 - DNA, 33 bp, Artificial Sequence
  Description of Artificial Sequence: Synthetic oligonucleotide
agtactggaacagccagaagaacttcctggaag

SEQ ID NO: 417585 - DNA, 32 bp, Artificial Sequence
  Description of Artificial Sequence: Synthetic oligonucleotide
gtactggaacagccagaagaacttcctggaag

SEQ ID NO: 417586 - DNA, 33 bp, Artificial Sequence
  Description of Artificial Sequence: Synthetic oligonucleotide
tactggaacagccagaagaacttcctggaagac

SEQ ID NO: 417587 - DNA, 32 bp, Artificial Sequence
  Description of Artificial Sequence: Synthetic oligonucleotide
actggaacagccagaagaacttcctggaagac

SEQ ID NO: 417588 - DNA, 31 bp, Artificial Sequence
  Description of Artificial Sequence: Synthetic oligonucleotide
ctggaacagccagaagaacttcctggaagac

SEQ ID NO: 417589 - DNA, 32 bp, Artificial Sequence
  Description of Artificial Sequence: Synthetic oligonucleotide
tggaacagccagaagaacttcctggaagacag

SEQ ID NO: 417590 - DNA, 31 bp, Artificial Sequence
  Description of Artificial Sequence: Synthetic oligonucleotide
ggaacagccagaagaacttcctggaagacag

SEQ ID NO: 417591 - DNA, 31 bp, Artificial Sequence
  Description of Artificial Sequence: Synthetic oligonucleotide
gaacagccagaagaacttcctggaagacagg

SEQ ID NO: 417592 - DNA, 31 bp, Artificial Sequence
  Description of Artificial Sequence: Synthetic oligonucleotide
aacagccagaagaacttcctggaagacaggc

SEQ ID NO: 417593 - DNA, 30 bp, Artificial Sequence
  Description of Artificial Sequence: Synthetic oligonucleotide
acagccagaagaacttcctggaagacaggc

SEQ ID NO: 417594 - DNA, 29 bp, Artificial Sequence
  Description of Artificial Sequence: Synthetic oligonucleotide
cagccagaagaacttcctggaagacaggc

SEQ ID NO: 417595 - DNA, 29 bp, Artificial Sequence
  Description of Artificial Sequence: Synthetic oligonucleotide
agccagaagaacttcctggaagacaggcg

SEQ ID NO: 417596 - DNA, 28 bp, Artificial Sequence
  Description of Artificial Sequence: Synthetic oligonucleotide
gccagaagaacttcctggaagacaggcg

SEQ ID NO: 417597 - DNA, 28 bp, Artificial Sequence
  Description of Artificial Sequence: Synthetic oligonucleotide
ccagaagaacttcctggaagacaggcgg

SEQ ID NO: 417598 - DNA, 28 bp, Artificial Sequence
  Description of Artificial Sequence: Synthetic oligonucleotide
cagaagaacttcctggaagacaggcggg

SEQ ID NO: 417599 - DNA, 28 bp, Artificial Sequence
  Description of Artificial Sequence: Synthetic oligonucleotide
agaagaacttcctggaagacaggcgggc

SEQ ID NO: 417600 - DNA, 27 bp, Artificial Sequence
  Description of Artificial Sequence: Synthetic oligonucleotide
gaagaacttcctggaagacaggcgggc

SEQ ID NO: 417601 - DNA, 27 bp, Artificial Sequence
  Description of Artificial Sequence: Synthetic oligonucleotide
aagaacttcctggaagacaggcgggcc

SEQ ID NO: 417602 - DNA, 26 bp, Artificial Sequence
  Description of Artificial Sequence: Synthetic oligonucleotide
agaacttcctggaagacaggcgggcc

SEQ ID NO: 417603 - DNA, 25 bp, Artificial Sequence
  Description of Artificial Sequence: Synthetic oligonucleotide
gaacttcctggaagacaggcgggcc

SEQ ID NO: 417604 - DNA, 25 bp, Artificial Sequence
  Description of Artificial Sequence: Synthetic oligonucleotide
aacttcctggaagacaggcgggccg

SEQ ID NO: 417605 - DNA, 20 bp, Artificial Sequence
  Description of Artificial Sequence: Synthetic oligonucleotide
aggcgggccgcggtggacag

SEQ ID NO: 417606 - DNA, 20 bp, Artificial Sequence
  Description of Artificial Sequence: Synthetic oligonucleotide
ggcgggccgcggtggacagt

SEQ ID NO: 417607 - DNA, 21 bp, Artificial Sequence
  Description of Artificial Sequence: Synthetic oligonucleotide
gcgggccgcggtggacagcta

SEQ ID NO: 417608 - DNA, 22 bp, Artificial Sequence
  Description of Artificial Sequence: Synthetic oligonucleotide
cgggccgcggtggacagctact

SEQ ID NO: 417609 - DNA, 22 bp, Artificial Sequence
  Description of Artificial Sequence: Synthetic oligonucleotide
gggccgcggtggacagctactg

SEQ ID NO: 417610 - DNA, 23 bp, Artificial Sequence
  Description of Artificial Sequence: Synthetic oligonucleotide
ggccgcggtggacagctactgca

SEQ ID NO: 417611 - DNA, 24 bp, Artificial Sequence
  Description of Artificial Sequence: Synthetic oligonucleotide
gccgcggtggacagctactgcaga

SEQ ID NO: 417612 - DNA, 25 bp, Artificial Sequence
  Description of Artificial Sequence: Synthetic oligonucleotide
ccgcggtggacagctactgcagaca

SEQ ID NO: 417613 - DNA, 27 bp, Artificial Sequence
  Description of Artificial Sequence: Synthetic oligonucleotide
cgcggtggacagctactgcagacacaa

SEQ ID NO: 417614 - DNA, 27 bp, Artificial Sequence
  Description of Artificial Sequence: Synthetic oligonucleotide
gcggtggacagctactgcagacacaac

SEQ ID NO: 417615 - DNA, 29 bp, Artificial Sequence
  Description of Artificial Sequence: Synthetic oligonucleotide
cggtggacagctactgcagacacaactac

SEQ ID NO: 417616 - DNA, 29 bp, Artificial Sequence
  Description of Artificial Sequence: Synthetic oligonucleotide
ggtggacagctactgcagacacaactacg

SEQ ID NO: 417617 - DNA, 29 bp, Artificial Sequence
  Description of Artificial Sequence: Synthetic oligonucleotide
gtggacagctactgcagacacaactacgg

SEQ ID NO: 417618 - DNA, 29 bp, Artificial Sequence
  Description of Artificial Sequence: Synthetic oligonucleotide
tggacagctactgcagacacaactacggg

SEQ ID NO: 417619 - DNA, 28 bp, Artificial Sequence
  Description of Artificial Sequence: Synthetic oligonucleotide
ggacagctactgcagacacaactacggg

SEQ ID NO: 417620 - DNA, 28 bp, Artificial Sequence
  Description of Artificial Sequence: Synthetic oligonucleotide
gacagctactgcagacacaactacgggg

SEQ ID NO: 417621 - DNA, 30 bp, Artificial Sequence
  Description of Artificial Sequence: Synthetic oligonucleotide
acagctactgcagacacaactacggggttg

SEQ ID NO: 417622 - DNA, 29 bp, Artificial Sequence
  Description of Artificial Sequence: Synthetic oligonucleotide
cagctactgcagacacaactacggggttg

SEQ ID NO: 417623 - DNA, 29 bp, Artificial Sequence
  Description of Artificial Sequence: Synthetic oligonucleotide
agctactgcagacacaactacggggttgg

SEQ ID NO: 417624 - DNA, 28 bp, Artificial Sequence
  Description of Artificial Sequence: Synthetic oligonucleotide
gctactgcagacacaactacggggttgg

SEQ ID NO: 417625 - DNA, 30 bp, Artificial Sequence; identical to SEQ ID NO: 70178
  Description of Artificial Sequence: Synthetic oligonucleotide

SEQ ID NO: 417626 - DNA, 31 bp, Artificial Sequence; identical to SEQ ID NO: 70179
  Description of Artificial Sequence: Synthetic oligonucleotide

SEQ ID NO: 417627 - DNA, 37 bp, Artificial Sequence; identical to SEQ ID NO: 70180
  Description of Artificial Sequence: Synthetic oligonucleotide

SEQ ID NO: 417628 - DNA, 37 bp, Artificial Sequence; identical to SEQ ID NO: 70181
  Description of Artificial Sequence: Synthetic oligonucleotide

SEQ ID NO: 417629 - DNA, 36 bp, Artificial Sequence; identical to SEQ ID NO: 70182
  Description of Artificial Sequence: Synthetic oligonucleotide

SEQ ID NO: 417630 - DNA, 35 bp, Artificial Sequence; identical to SEQ ID NO: 70183
  Description of Artificial Sequence: Synthetic oligonucleotide

SEQ ID NO: 417631 - DNA, 36 bp, Artificial Sequence; identical to SEQ ID NO: 70184
  Description of Artificial Sequence: Synthetic oligonucleotide

SEQ ID NO: 417632 - DNA, 36 bp, Artificial Sequence; identical to SEQ ID NO: 70185
  Description of Artificial Sequence: Synthetic oligonucleotide

SEQ ID NO: 417633 - DNA, 35 bp, Artificial Sequence; identical to SEQ ID NO: 70186
  Description of Artificial Sequence: Synthetic oligonucleotide

SEQ ID NO: 417634 - DNA, 35 bp, Artificial Sequence; identical to SEQ ID NO: 70187
  Description of Artificial Sequence: Synthetic oligonucleotide

SEQ ID NO: 417635 - DNA, 35 bp, Artificial Sequence; identical to SEQ ID NO: 70188
  Description of Artificial Sequence: Synthetic oligonucleotide

SEQ ID NO: 417636 - DNA, 34 bp, Artificial Sequence; identical to SEQ ID NO: 70189
  Description of Artificial Sequence: Synthetic oligonucleotide

SEQ ID NO: 417637 - DNA, 36 bp, Artificial Sequence; identical to SEQ ID NO: 70190
  Description of Artificial Sequence: Synthetic oligonucleotide

SEQ ID NO: 417638 - DNA, 35 bp, Artificial Sequence; identical to SEQ ID NO: 70191
  Description of Artificial Sequence: Synthetic oligonucleotide

SEQ ID NO: 417639 - DNA, 35 bp, Artificial Sequence; identical to SEQ ID NO: 70192
  Description of Artificial Sequence: Synthetic oligonucleotide

SEQ ID NO: 417640 - DNA, 34 bp, Artificial Sequence; identical to SEQ ID NO: 70193
  Description of Artificial Sequence: Synthetic oligonucleotide

SEQ ID NO: 417641 - DNA, 33 bp, Artificial Sequence; identical to SEQ ID NO: 70194
  Description of Artificial Sequence: Synthetic oligonucleotide

SEQ ID NO: 417642 - DNA, 32 bp, Artificial Sequence; identical to SEQ ID NO: 70195
  Description of Artificial Sequence: Synthetic oligonucleotide

SEQ ID NO: 417643 - DNA, 33 bp, Artificial Sequence; identical to SEQ ID NO: 70196
  Description of Artificial Sequence: Synthetic oligonucleotide

SEQ ID NO: 417644 - DNA, 32 bp, Artificial Sequence; identical to SEQ ID NO: 70197
  Description of Artificial Sequence: Synthetic oligonucleotide

SEQ ID NO: 417645 - DNA, 31 bp, Artificial Sequence; identical to SEQ ID NO: 70198
  Description of Artificial Sequence: Synthetic oligonucleotide

SEQ ID NO: 417646 - DNA, 32 bp, Artificial Sequence; identical to SEQ ID NO: 70199
  Description of Artificial Sequence: Synthetic oligonucleotide

SEQ ID NO: 417647 - DNA, 31 bp, Artificial Sequence; identical to SEQ ID NO: 70200
  Description of Artificial Sequence: Synthetic oligonucleotide

SEQ ID NO: 417648 - DNA, 30 bp, Artificial Sequence; identical to SEQ ID NO: 70201
  Description of Artificial Sequence: Synthetic oligonucleotide

SEQ ID NO: 417649 - DNA, 29 bp, Artificial Sequence
  Description of Artificial Sequence: Synthetic oligonucleotide
aaccaagaggagttcgtgcgcttcgacag

SEQ ID NO: 417650 - DNA, 28 bp, Artificial Sequence
  Description of Artificial Sequence: Synthetic oligonucleotide
accaagaggagttcgtgcgcttcgacag

SEQ ID NO: 417651 - DNA, 27 bp, Artificial Sequence
  Description of Artificial Sequence: Synthetic oligonucleotide
ccaagaggagttcgtgcgcttcgacag

SEQ ID NO: 417652 - DNA, 27 bp, Artificial Sequence
  Description of Artificial Sequence: Synthetic oligonucleotide
caagaggagttcgtgcgcttcgacagc

SEQ ID NO: 417653 - DNA, 27 bp, Artificial Sequence
  Description of Artificial Sequence: Synthetic oligonucleotide
aagaggagttcgtgcgcttcgacagcg

SEQ ID NO: 417654 - DNA, 27 bp, Artificial Sequence
  Description of Artificial Sequence: Synthetic oligonucleotide
agaggagttcgtgcgcttcgacagcga

SEQ ID NO: 417655 - DNA, 36 bp, Artificial Sequence; identical to SEQ ID NO: 70208
  Description of Artificial Sequence: Synthetic oligonucleotide

SEQ ID NO: 417656 - DNA, 35 bp, Artificial Sequence; identical to SEQ ID NO: 70209
  Description of Artificial Sequence: Synthetic oligonucleotide

SEQ ID NO: 417657 - DNA, 34 bp, Artificial Sequence; identical to SEQ ID NO: 70210
  Description of Artificial Sequence: Synthetic oligonucleotide

SEQ ID NO: 417658 - DNA, 34 bp, Artificial Sequence; identical to SEQ ID NO: 70211
  Description of Artificial Sequence: Synthetic oligonucleotide

SEQ ID NO: 417659 - DNA, 35 bp, Artificial Sequence; identical to SEQ ID NO: 70212
  Description of Artificial Sequence: Synthetic oligonucleotide

SEQ ID NO: 417660 - DNA, 34 bp, Artificial Sequence; identical to SEQ ID NO: 70213
  Description of Artificial Sequence: Synthetic oligonucleotide

SEQ ID NO: 417661 - DNA, 34 bp, Artificial Sequence; identical to SEQ ID NO: 70214
  Description of Artificial Sequence: Synthetic oligonucleotide

SEQ ID NO: 417662 - DNA, 34 bp, Artificial Sequence; identical to SEQ ID NO: 70215
  Description of Artificial Sequence: Synthetic oligonucleotide

SEQ ID NO: 417663 - DNA, 33 bp, Artificial Sequence; identical to SEQ ID NO: 70216
  Description of Artificial Sequence: Synthetic oligonucleotide

SEQ ID NO: 417664 - DNA, 33 bp, Artificial Sequence; identical to SEQ ID NO: 70217
  Description of Artificial Sequence: Synthetic oligonucleotide

SEQ ID NO: 417665 - DNA, 32 bp, Artificial Sequence; identical to SEQ ID NO: 70218
  Description of Artificial Sequence: Synthetic oligonucleotide

SEQ ID NO: 417666 - DNA, 34 bp, Artificial Sequence; identical to SEQ ID NO: 70219
  Description of Artificial Sequence: Synthetic oligonucleotide

SEQ ID NO: 417667 - DNA, 33 bp, Artificial Sequence; identical to SEQ ID NO: 70220
  Description of Artificial Sequence: Synthetic oligonucleotide

SEQ ID NO: 417668 - DNA, 32 bp, Artificial Sequence; identical to SEQ ID NO: 68492
  Description of Artificial Sequence: Synthetic oligonucleotide

SEQ ID NO: 417669 - DNA, 24 bp, Artificial Sequence
  Description of Artificial Sequence: Synthetic oligonucleotide
cagcccctgcagcaccacaacctg

SEQ ID NO: 417670 - DNA, 25 bp, Artificial Sequence
  Description of Artificial Sequence: Synthetic oligonucleotide
agcccctgcagcaccacaacctgct

SEQ ID NO: 417671 - DNA, 24 bp, Artificial Sequence
  Description of Artificial Sequence: Synthetic oligonucleotide
gcccctgcagcaccacaacctgct

SEQ ID NO: 417672 - DNA, 24 bp, Artificial Sequence
  Description of Artificial Sequence: Synthetic oligonucleotide
cccctgcagcaccacaacctgctg

SEQ ID NO: 417673 - DNA, 25 bp, Artificial Sequence
  Description of Artificial Sequence: Synthetic oligonucleotide
ccctgcagcaccacaacctgctggt

SEQ ID NO: 417674 - DNA, 26 bp, Artificial Sequence
  Description of Artificial Sequence: Synthetic oligonucleotide
cctgcagcaccacaacctgctggtct

SEQ ID NO: 417675 - DNA, 27 bp, Artificial Sequence
  Description of Artificial Sequence: Synthetic oligonucleotide
ctgcagcaccacaacctgctggtctgt

SEQ ID NO: 417676 - DNA, 28 bp, Artificial Sequence
  Description of Artificial Sequence: Synthetic oligonucleotide
tgcagcaccacaacctgctggtctgttc

SEQ ID NO: 417677 - DNA, 27 bp, Artificial Sequence
  Description of Artificial Sequence: Synthetic oligonucleotide
gcagcaccacaacctgctggtctgttc

SEQ ID NO: 417678 - DNA, 28 bp, Artificial Sequence
  Description of Artificial Sequence: Synthetic oligonucleotide
cagcaccacaacctgctggtctgttctg

SEQ ID NO: 417679 - DNA, 29 bp, Artificial Sequence
  Description of Artificial Sequence: Synthetic oligonucleotide
agcaccacaacctgctggtctgttctgtg

SEQ ID NO: 417680 - DNA, 28 bp, Artificial Sequence
  Description of Artificial Sequence: Synthetic oligonucleotide
gcaccacaacctgctggtctgttctgtg

SEQ ID NO: 417681 - DNA, 29 bp, Artificial Sequence
  Description of Artificial Sequence: Synthetic oligonucleotide
caccacaacctgctggtctgttctgtgag

SEQ ID NO: 417682 - DNA, 30 bp, Artificial Sequence; identical to SEQ ID NO: 70234
  Description of Artificial Sequence: Synthetic oligonucleotide

SEQ ID NO: 417683 - DNA, 29 bp, Artificial Sequence
  Description of Artificial Sequence: Synthetic oligonucleotide
ccacaacctgctggtctgttctgtgagtg

SEQ ID NO: 417684 - DNA, 29 bp, Artificial Sequence
  Description of Artificial Sequence: Synthetic oligonucleotide
cacaacctgctggtctgttctgtgagtgg

SEQ ID NO: 417685 - DNA, 32 bp, Artificial Sequence; identical to SEQ ID NO: 70237
  Description of Artificial Sequence: Synthetic oligonucleotide

SEQ ID NO: 417686 - DNA, 31 bp, Artificial Sequence; identical to SEQ ID NO: 70238
  Description of Artificial Sequence: Synthetic oligonucleotide

SEQ ID NO: 417687 - DNA, 34 bp, Artificial Sequence; identical to SEQ ID NO: 70239
  Description of Artificial Sequence: Synthetic oligonucleotide

SEQ ID NO: 417688 - DNA, 33 bp, Artificial Sequence; identical to SEQ ID NO: 70240
  Description of Artificial Sequence: Synthetic oligonucleotide

SEQ ID NO: 417689 - DNA, 32 bp, Artificial Sequence; identical to SEQ ID NO: 70241
  Description of Artificial Sequence: Synthetic oligonucleotide

SEQ ID NO: 417690 - DNA, 32 bp, Artificial Sequence; identical to SEQ ID NO: 70242
  Description of Artificial Sequence: Synthetic oligonucleotide

SEQ ID NO: 417691 - DNA, 33 bp, Artificial Sequence; identical to SEQ ID NO: 70243
  Description of Artificial Sequence: Synthetic oligonucleotide

SEQ ID NO: 417692 - DNA, 32 bp, Artificial Sequence; identical to SEQ ID NO: 70244
  Description of Artificial Sequence: Synthetic oligonucleotide

SEQ ID NO: 417693 - DNA, 28 bp, Artificial Sequence
  Description of Artificial Sequence: Synthetic oligonucleotide
gttccggaatggccaggaagagaagacg

SEQ ID NO: 417694 - DNA, 28 bp, Artificial Sequence
  Description of Artificial Sequence: Synthetic oligonucleotide
ttccggaatggccaggaagagaagacgg

SEQ ID NO: 417695 - DNA, 27 bp, Artificial Sequence
  Description of Artificial Sequence: Synthetic oligonucleotide
tccggaatggccaggaagagaagacgg

SEQ ID NO: 417696 - DNA, 26 bp, Artificial Sequence
  Description of Artificial Sequence: Synthetic oligonucleotide
ccggaatggccaggaagagaagacgg

SEQ ID NO: 417697 - DNA, 26 bp, Artificial Sequence
  Description of Artificial Sequence: Synthetic oligonucleotide
cggaatggccaggaagagaagacggg

SEQ ID NO: 417698 - DNA, 26 bp, Artificial Sequence
  Description of Artificial Sequence: Synthetic oligonucleotide
ggaatggccaggaagagaagacgggg

SEQ ID NO: 417699 - DNA, 27 bp, Artificial Sequence
  Description of Artificial Sequence: Synthetic oligonucleotide
gaatggccaggaagagaagacgggggt

SEQ ID NO: 417700 - DNA, 27 bp, Artificial Sequence
  Description of Artificial Sequence: Synthetic oligonucleotide
aatggccaggaagagaagacgggggtg

SEQ ID NO: 417701 - DNA, 26 bp, Artificial Sequence
  Description of Artificial Sequence: Synthetic oligonucleotide
atggccaggaagagaagacgggggtg

SEQ ID NO: 417702 - DNA, 25 bp, Artificial Sequence
  Description of Artificial Sequence: Synthetic oligonucleotide
tggccaggaagagaagacgggggtg

SEQ ID NO: 417703 - DNA, 24 bp, Artificial Sequence
  Description of Artificial Sequence: Synthetic oligonucleotide
ggccaggaagagaagacgggggtg

SEQ ID NO: 417704 - DNA, 25 bp, Artificial Sequence
  Description of Artificial Sequence: Synthetic oligonucleotide
gccaggaagagaagacgggggtggt

SEQ ID NO: 417705 - DNA, 26 bp, Artificial Sequence
  Description of Artificial Sequence: Synthetic oligonucleotide
ccaggaagagaagacgggggtggtgt

SEQ ID NO: 417706 - DNA, 26 bp, Artificial Sequence
  Description of Artificial Sequence: Synthetic oligonucleotide
caggaagagaagacgggggtggtgtc

SEQ ID NO: 417707 - DNA, 27 bp, Artificial Sequence
  Description of Artificial Sequence: Synthetic oligonucleotide
aggaagagaagacgggggtggtgtcca

SEQ ID NO: 417708 - DNA, 26 bp, Artificial Sequence
  Description of Artificial Sequence: Synthetic oligonucleotide
ggaagagaagacgggggtggtgtcca

SEQ ID NO: 417709 - DNA, 27 bp, Artificial Sequence
  Description of Artificial Sequence: Synthetic oligonucleotide
gaagagaagacgggggtggtgtccaca

SEQ ID NO: 417710 - DNA, 27 bp, Artificial Sequence
  Description of Artificial Sequence: Synthetic oligonucleotide
aagagaagacgggggtggtgtccacag

SEQ ID NO: 417711 - DNA, 26 bp, Artificial Sequence
  Description of Artificial Sequence: Synthetic oligonucleotide
agagaagacgggggtggtgtccacag

SEQ ID NO: 417712 - DNA, 25 bp, Artificial Sequence
  Description of Artificial Sequence: Synthetic oligonucleotide
gagaagacgggggtggtgtccacag

SEQ ID NO: 417713 - DNA, 25 bp, Artificial Sequence
  Description of Artificial Sequence: Synthetic oligonucleotide
agaagacgggggtggtgtccacagg

SEQ ID NO: 417714 - DNA, 24 bp, Artificial Sequence
  Description of Artificial Sequence: Synthetic oligonucleotide
gaagacgggggtggtgtccacagg

SEQ ID NO: 417715 - DNA, 24 bp, Artificial Sequence
  Description of Artificial Sequence: Synthetic oligonucleotide
aagacgggggtggtgtccacaggc

SEQ ID NO: 417716 - DNA, 23 bp, Artificial Sequence
  Description of Artificial Sequence: Synthetic oligonucleotide
agacgggggtggtgtccacaggc

SEQ ID NO: 417717 - DNA, 22 bp, Artificial Sequence
  Description of Artificial Sequence: Synthetic oligonucleotide
gacgggggtggtgtccacaggc

SEQ ID NO: 417718 - DNA, 23 bp, Artificial Sequence
  Description of Artificial Sequence: Synthetic oligonucleotide
acgggggtggtgtccacaggcct

SEQ ID NO: 417719 - DNA, 22 bp, Artificial Sequence
  Description of Artificial Sequence: Synthetic oligonucleotide
cgggggtggtgtccacaggcct

SEQ ID NO: 417720 - DNA, 24 bp, Artificial Sequence
  Description of Artificial Sequence: Synthetic oligonucleotide
gggggtggtgtccacaggcctgat

SEQ ID NO: 417721 - DNA, 36 bp, Artificial Sequence; identical to SEQ ID NO: 70273
  Description of Artificial Sequence: Synthetic oligonucleotide

SEQ ID NO: 417722 - DNA, 36 bp, Artificial Sequence; identical to SEQ ID NO: 70274
  Description of Artificial Sequence: Synthetic oligonucleotide

SEQ ID NO: 417723 - DNA, 35 bp, Artificial Sequence; identical to SEQ ID NO: 70275
  Description of Artificial Sequence: Synthetic oligonucleotide

SEQ ID NO: 417724 - DNA, 35 bp, Artificial Sequence; identical to SEQ ID NO: 70276
  Description of Artificial Sequence: Synthetic oligonucleotide

SEQ ID NO: 417725 - DNA, 35 bp, Artificial Sequence; identical to SEQ ID NO: 70277
  Description of Artificial Sequence: Synthetic oligonucleotide

SEQ ID NO: 417726 - DNA, 34 bp, Artificial Sequence; identical to SEQ ID NO: 70278
  Description of Artificial Sequence: Synthetic oligonucleotide

SEQ ID NO: 417727 - DNA, 36 bp, Artificial Sequence; identical to SEQ ID NO: 70279
  Description of Artificial Sequence: Synthetic oligonucleotide

SEQ ID NO: 417728 - DNA, 35 bp, Artificial Sequence; identical to SEQ ID NO: 70280
  Description of Artificial Sequence: Synthetic oligonucleotide

SEQ ID NO: 417729 - DNA, 35 bp, Artificial Sequence; identical to SEQ ID NO: 70281
  Description of Artificial Sequence: Synthetic oligonucleotide

SEQ ID NO: 417730 - DNA, 34 bp, Artificial Sequence; identical to SEQ ID NO: 70282
  Description of Artificial Sequence: Synthetic oligonucleotide

SEQ ID NO: 417731 - DNA, 33 bp, Artificial Sequence; identical to SEQ ID NO: 70283
  Description of Artificial Sequence: Synthetic oligonucleotide

SEQ ID NO: 417732 - DNA, 32 bp, Artificial Sequence; identical to SEQ ID NO: 70284
  Description of Artificial Sequence: Synthetic oligonucleotide

SEQ ID NO: 417733 - DNA, 33 bp, Artificial Sequence; identical to SEQ ID NO: 70285
  Description of Artificial Sequence: Synthetic oligonucleotide

SEQ ID NO: 417734 - DNA, 32 bp, Artificial Sequence; identical to SEQ ID NO: 70286
  Description of Artificial Sequence: Synthetic oligonucleotide

SEQ ID NO: 417735 - DNA, 31 bp, Artificial Sequence; identical to SEQ ID NO: 70287
  Description of Artificial Sequence: Synthetic oligonucleotide

SEQ ID NO: 417736 - DNA, 32 bp, Artificial Sequence; identical to SEQ ID NO: 70288
  Description of Artificial Sequence: Synthetic oligonucleotide

SEQ ID NO: 417737 - DNA, 31 bp, Artificial Sequence; identical to SEQ ID NO: 70289
  Description of Artificial Sequence: Synthetic oligonucleotide

SEQ ID NO: 417738 - DNA, 30 bp, Artificial Sequence; identical to SEQ ID NO: 70290
  Description of Artificial Sequence: Synthetic oligonucleotide

SEQ ID NO: 417739 - DNA, 29 bp, Artificial Sequence
  Description of Artificial Sequence: Synthetic oligonucleotide
aaccaagaggaggacttgcgcttcgacag

SEQ ID NO: 417740 - DNA, 28 bp, Artificial Sequence
  Description of Artificial Sequence: Synthetic oligonucleotide
accaagaggaggacttgcgcttcgacag

SEQ ID NO: 417741 - DNA, 27 bp, Artificial Sequence
  Description of Artificial Sequence: Synthetic oligonucleotide
ccaagaggaggacttgcgcttcgacag

SEQ ID NO: 417742 - DNA, 27 bp, Artificial Sequence
  Description of Artificial Sequence: Synthetic oligonucleotide
caagaggaggacttgcgcttcgacagc

SEQ ID NO: 417743 - DNA, 27 bp, Artificial Sequence
  Description of Artificial Sequence: Synthetic oligonucleotide
aagaggaggacttgcgcttcgacagcg

SEQ ID NO: 417744 - DNA, 27 bp, Artificial Sequence
  Description of Artificial Sequence: Synthetic oligonucleotide
agaggaggacttgcgcttcgacagcga

SEQ ID NO: 417745 - DNA, 26 bp, Artificial Sequence
  Description of Artificial Sequence: Synthetic oligonucleotide
gaggaggacttgcgcttcgacagcga

SEQ ID NO: 417746 - DNA, 26 bp, Artificial Sequence
  Description of Artificial Sequence: Synthetic oligonucleotide
aggaggacttgcgcttcgacagcgac

SEQ ID NO: 417747 - DNA, 25 bp, Artificial Sequence
  Description of Artificial Sequence: Synthetic oligonucleotide
ggaggacttgcgcttcgacagcgac

SEQ ID NO: 417748 - DNA, 26 bp, Artificial Sequence
  Description of Artificial Sequence: Synthetic oligonucleotide
gaggacttgcgcttcgacagcgacgt

SEQ ID NO: 417749 - DNA, 26 bp, Artificial Sequence
  Description of Artificial Sequence: Synthetic oligonucleotide
aggacttgcgcttcgacagcgacgtg

SEQ ID NO: 417750 - DNA, 25 bp, Artificial Sequence
  Description of Artificial Sequence: Synthetic oligonucleotide
ggacttgcgcttcgacagcgacgtg

SEQ ID NO: 417751 - DNA, 25 bp, Artificial Sequence
  Description of Artificial Sequence: Synthetic oligonucleotide
gacttgcgcttcgacagcgacgtgg

SEQ ID NO: 417752 - DNA, 25 bp, Artificial Sequence
  Description of Artificial Sequence: Synthetic oligonucleotide
acttgcgcttcgacagcgacgtggg

SEQ ID NO: 417753 - DNA, 24 bp, Artificial Sequence
  Description of Artificial Sequence: Synthetic oligonucleotide
cttgcgcttcgacagcgacgtggg

SEQ ID NO: 417754 - DNA, 24 bp, Artificial Sequence
  Description of Artificial Sequence: Synthetic oligonucleotide
ttgcgcttcgacagcgacgtgggg

SEQ ID NO: 417755 - DNA, 25 bp, Artificial Sequence
  Description of Artificial Sequence: Synthetic oligonucleotide
aggcgggccgaggtggacacctatt

SEQ ID NO: 417756 - DNA, 24 bp, Artificial Sequence
  Description of Artificial Sequence: Synthetic oligonucleotide
ggcgggccgaggtggacacctatt

SEQ ID NO: 417757 - DNA, 24 bp, Artificial Sequence
  Description of Artificial Sequence: Synthetic oligonucleotide
gcgggccgaggtggacacctattg

SEQ ID NO: 417758 - DNA, 25 bp, Artificial Sequence
  Description of Artificial Sequence: Synthetic oligonucleotide
cgggccgaggtggacacctattgca

SEQ ID NO: 417759 - DNA, 26 bp, Artificial Sequence
  Description of Artificial Sequence: Synthetic oligonucleotide
gggccgaggtggacacctattgcaga

SEQ ID NO: 417760 - DNA, 27 bp, Artificial Sequence
  Description of Artificial Sequence: Synthetic oligonucleotide
ggccgaggtggacacctattgcagaca

SEQ ID NO: 417761 - DNA, 27 bp, Artificial Sequence
  Description of Artificial Sequence: Synthetic oligonucleotide
gccgaggtggacacctattgcagacac

SEQ ID NO: 417762 - DNA, 29 bp, Artificial Sequence
  Description of Artificial Sequence: Synthetic oligonucleotide
ccgaggtggacacctattgcagacacaac

SEQ ID NO: 417763 - DNA, 31 bp, Artificial Sequence; identical to SEQ ID NO: 70315
  Description of Artificial Sequence: Synthetic oligonucleotide

SEQ ID NO: 417764 - DNA, 31 bp, Artificial Sequence; identical to SEQ ID NO: 70316
  Description of Artificial Sequence: Synthetic oligonucleotide

SEQ ID NO: 417765 - DNA, 31 bp, Artificial Sequence; identical to SEQ ID NO: 70317
  Description of Artificial Sequence: Synthetic oligonucleotide

SEQ ID NO: 417766 - DNA, 25 bp, Artificial Sequence
  Description of Artificial Sequence: Synthetic oligonucleotide
acaggcgggccgcggtggacaatta

SEQ ID NO: 417767 - DNA, 24 bp, Artificial Sequence
  Description of Artificial Sequence: Synthetic oligonucleotide
caggcgggccgcggtggacaatta

SEQ ID NO: 417768 - DNA, 22 bp, Artificial Sequence
  Description of Artificial Sequence: Synthetic oligonucleotide
acaggcgggccgcggtggacaa

SEQ ID NO: 417769 - DNA, 21 bp, Artificial Sequence
  Description of Artificial Sequence: Synthetic oligonucleotide
caggcgggccgcggtggacaa

SEQ ID NO: 417770 - DNA, 23 bp, Artificial Sequence
  Description of Artificial Sequence: Synthetic oligonucleotide
aggcgggccgcggtggacaacta

SEQ ID NO: 417771 - DNA, 22 bp, Artificial Sequence
  Description of Artificial Sequence: Synthetic oligonucleotide
ggcgggccgcggtggacaacta

SEQ ID NO: 417772 - DNA, 37 bp, Artificial Sequence; identical to SEQ ID NO: 70346
  Description of Artificial Sequence: Synthetic oligonucleotide

SEQ ID NO: 417773 - DNA, 37 bp, Artificial Sequence; identical to SEQ ID NO: 70347
  Description of Artificial Sequence: Synthetic oligonucleotide

SEQ ID NO: 417774 - DNA, 36 bp, Artificial Sequence; identical to SEQ ID NO: 70348
  Description of Artificial Sequence: Synthetic oligonucleotide

SEQ ID NO: 417775 - DNA, 36 bp, Artificial Sequence; identical to SEQ ID NO: 70349
  Description of Artificial Sequence: Synthetic oligonucleotide

SEQ ID NO: 417776 - DNA, 35 bp, Artificial Sequence; identical to SEQ ID NO: 70350
  Description of Artificial Sequence: Synthetic oligonucleotide

SEQ ID NO: 417777 - DNA, 34 bp, Artificial Sequence; identical to SEQ ID NO: 70351
  Description of Artificial Sequence: Synthetic oligonucleotide

SEQ ID NO: 417778 - DNA, 34 bp, Artificial Sequence; identical to SEQ ID NO: 70352
  Description of Artificial Sequence: Synthetic oligonucleotide

SEQ ID NO: 417779 - DNA, 35 bp, Artificial Sequence; identical to SEQ ID NO: 70353
  Description of Artificial Sequence: Synthetic oligonucleotide

SEQ ID NO: 417780 - DNA, 34 bp, Artificial Sequence; identical to SEQ ID NO: 70354
  Description of Artificial Sequence: Synthetic oligonucleotide

SEQ ID NO: 417781 - DNA, 34 bp, Artificial Sequence; identical to SEQ ID NO: 70355
  Description of Artificial Sequence: Synthetic oligonucleotide

SEQ ID NO: 417782 - DNA, 34 bp, Artificial Sequence; identical to SEQ ID NO: 70356
  Description of Artificial Sequence: Synthetic oligonucleotide

SEQ ID NO: 417783 - DNA, 33 bp, Artificial Sequence; identical to SEQ ID NO: 70357
  Description of Artificial Sequence: Synthetic oligonucleotide

SEQ ID NO: 417784 - DNA, 33 bp, Artificial Sequence; identical to SEQ ID NO: 70358
  Description of Artificial Sequence: Synthetic oligonucleotide

SEQ ID NO: 417785 - DNA, 32 bp, Artificial Sequence; identical to SEQ ID NO: 70359
  Description of Artificial Sequence: Synthetic oligonucleotide

SEQ ID NO: 417786 - DNA, 34 bp, Artificial Sequence; identical to SEQ ID NO: 70360
  Description of Artificial Sequence: Synthetic oligonucleotide

SEQ ID NO: 417787 - DNA, 33 bp, Artificial Sequence; identical to SEQ ID NO: 70361
  Description of Artificial Sequence: Synthetic oligonucleotide

SEQ ID NO: 417788 - DNA, 32 bp, Artificial Sequence; identical to SEQ ID NO: 70362
  Description of Artificial Sequence: Synthetic oligonucleotide

SEQ ID NO: 417789 - DNA, 31 bp, Artificial Sequence; identical to SEQ ID NO: 70363
  Description of Artificial Sequence: Synthetic oligonucleotide

SEQ ID NO: 417790 - DNA, 31 bp, Artificial Sequence; identical to SEQ ID NO: 70364
  Description of Artificial Sequence: Synthetic oligonucleotide

SEQ ID NO: 417791 - DNA, 33 bp, Artificial Sequence; identical to SEQ ID NO: 70380
  Description of Artificial Sequence: Synthetic oligonucleotide

SEQ ID NO: 417792 - DNA, 37 bp, Artificial Sequence; identical to SEQ ID NO: 70381
  Description of Artificial Sequence: Synthetic oligonucleotide

SEQ ID NO: 417793 - DNA, 36 bp, Artificial Sequence; identical to SEQ ID NO: 70382
  Description of Artificial Sequence: Synthetic oligonucleotide

SEQ ID NO: 417794 - DNA, 38 bp, Artificial Sequence; identical to SEQ ID NO: 70383
  Description of Artificial Sequence: Synthetic oligonucleotide

SEQ ID NO: 417795 - DNA, 41 bp, Artificial Sequence; identical to SEQ ID NO: 70384
  Description of Artificial Sequence: Synthetic oligonucleotide

SEQ ID NO: 417796 - DNA, 40 bp, Artificial Sequence; identical to SEQ ID NO: 70385
  Description of Artificial Sequence: Synthetic oligonucleotide

SEQ ID NO: 417797 - DNA, 39 bp, Artificial Sequence; identical to SEQ ID NO: 70386
  Description of Artificial Sequence: Synthetic oligonucleotide

SEQ ID NO: 417798 - DNA, 38 bp, Artificial Sequence; identical to SEQ ID NO: 70387
  Description of Artificial Sequence: Synthetic oligonucleotide

SEQ ID NO: 417799 - DNA, 38 bp, Artificial Sequence; identical to SEQ ID NO: 70388
  Description of Artificial Sequence: Synthetic oligonucleotide

SEQ ID NO: 417800 - DNA, 37 bp, Artificial Sequence; identical to SEQ ID NO: 70389
  Description of Artificial Sequence: Synthetic oligonucleotide

SEQ ID NO: 417801 - DNA, 36 bp, Artificial Sequence; identical to SEQ ID NO: 70390
  Description of Artificial Sequence: Synthetic oligonucleotide

SEQ ID NO: 417802 - DNA, 36 bp, Artificial Sequence; identical to SEQ ID NO: 70391
  Description of Artificial Sequence: Synthetic oligonucleotide

SEQ ID NO: 417803 - DNA, 37 bp, Artificial Sequence; identical to SEQ ID NO: 70392
  Description of Artificial Sequence: Synthetic oligonucleotide

SEQ ID NO: 417804 - DNA, 36 bp, Artificial Sequence; identical to SEQ ID NO: 70393
  Description of Artificial Sequence: Synthetic oligonucleotide

SEQ ID NO: 417805 - DNA, 36 bp, Artificial Sequence; identical to SEQ ID NO: 70394
  Description of Artificial Sequence: Synthetic oligonucleotide

SEQ ID NO: 417806 - DNA, 36 bp, Artificial Sequence; identical to SEQ ID NO: 70395
  Description of Artificial Sequence: Synthetic oligonucleotide

SEQ ID NO: 417807 - DNA, 35 bp, Artificial Sequence; identical to SEQ ID NO: 70396
  Description of Artificial Sequence: Synthetic oligonucleotide

SEQ ID NO: 417808 - DNA, 36 bp, Artificial Sequence; identical to SEQ ID NO: 70397
  Description of Artificial Sequence: Synthetic oligonucleotide

SEQ ID NO: 417809 - DNA, 36 bp, Artificial Sequence; identical to SEQ ID NO: 70398
  Description of Artificial Sequence: Synthetic oligonucleotide

SEQ ID NO: 417810 - DNA, 23 bp, Artificial Sequence
  Description of Artificial Sequence: Synthetic oligonucleotide
agctggggcggcctgatgaggag

SEQ ID NO: 417811 - DNA, 22 bp, Artificial Sequence
  Description of Artificial Sequence: Synthetic oligonucleotide
gctggggcggcctgatgaggag

SEQ ID NO: 417812 - DNA, 23 bp, Artificial Sequence
  Description of Artificial Sequence: Synthetic oligonucleotide
ctggggcggcctgatgaggagca

SEQ ID NO: 417813 - DNA, 24 bp, Artificial Sequence
  Description of Artificial Sequence: Synthetic oligonucleotide
tggggcggcctgatgaggagcact

SEQ ID NO: 417814 - DNA, 23 bp, Artificial Sequence
  Description of Artificial Sequence: Synthetic oligonucleotide
ggggcggcctgatgaggagcact

SEQ ID NO: 417815 - DNA, 23 bp, Artificial Sequence
  Description of Artificial Sequence: Synthetic oligonucleotide
gggcggcctgatgaggagcactg

SEQ ID NO: 417816 - DNA, 25 bp, Artificial Sequence
  Description of Artificial Sequence: Synthetic oligonucleotide
ggcggcctgatgaggagcactggaa

SEQ ID NO: 417817 - DNA, 26 bp, Artificial Sequence
  Description of Artificial Sequence: Synthetic oligonucleotide
gcggcctgatgaggagcactggaaca

SEQ ID NO: 417818 - DNA, 26 bp, Artificial Sequence
  Description of Artificial Sequence: Synthetic oligonucleotide
cggcctgatgaggagcactggaacag

SEQ ID NO: 417819 - DNA, 26 bp, Artificial Sequence
  Description of Artificial Sequence: Synthetic oligonucleotide
ggcctgatgaggagcactggaacagc

SEQ ID NO: 417820 - DNA, 27 bp, Artificial Sequence
  Description of Artificial Sequence: Synthetic oligonucleotide
gcctgatgaggagcactggaacagcca

SEQ ID NO: 417821 - DNA, 27 bp, Artificial Sequence
  Description of Artificial Sequence: Synthetic oligonucleotide
cctgatgaggagcactggaacagccag

SEQ ID NO: 417822 - DNA, 29 bp, Artificial Sequence
  Description of Artificial Sequence: Synthetic oligonucleotide
ctgatgaggagcactggaacagccagaag

SEQ ID NO: 417823 - DNA, 29 bp, Artificial Sequence
  Description of Artificial Sequence: Synthetic oligonucleotide
tgatgaggagcactggaacagccagaagg

SEQ ID NO: 417824 - DNA, 28 bp, Artificial Sequence
  Description of Artificial Sequence: Synthetic oligonucleotide
gatgaggagcactggaacagccagaagg

SEQ ID NO: 417825 - DNA, 29 bp, Artificial Sequence
  Description of Artificial Sequence: Synthetic oligonucleotide
atgaggagcactggaacagccagaaggac

SEQ ID NO: 417826 - DNA, 28 bp, Artificial Sequence
  Description of Artificial Sequence: Synthetic oligonucleotide
tgaggagcactggaacagccagaaggac

SEQ ID NO: 417827 - DNA, 27 bp, Artificial Sequence
  Description of Artificial Sequence: Synthetic oligonucleotide
gaggagcactggaacagccagaaggac

SEQ ID NO: 417828 - DNA, 29 bp, Artificial Sequence
  Description of Artificial Sequence: Synthetic oligonucleotide
aggagcactggaacagccagaaggacatc

SEQ ID NO: 417829 - DNA, 25 bp, Artificial Sequence
  Description of Artificial Sequence: Synthetic oligonucleotide
acttcctggaagacaggcgggccgt

SEQ ID NO: 417830 - DNA, 24 bp, Artificial Sequence
  Description of Artificial Sequence: Synthetic oligonucleotide
cttcctggaagacaggcgggccgt

SEQ ID NO: 417831 - DNA, 24 bp, Artificial Sequence
  Description of Artificial Sequence: Synthetic oligonucleotide
ttcctggaagacaggcgggccgtg

SEQ ID NO: 417832 - DNA, 23 bp, Artificial Sequence
  Description of Artificial Sequence: Synthetic oligonucleotide
tcctggaagacaggcgggccgtg

SEQ ID NO: 417833 - DNA, 22 bp, Artificial Sequence
  Description of Artificial Sequence: Synthetic oligonucleotide
cctggaagacaggcgggccgtg

SEQ ID NO: 417834 - DNA, 23 bp, Artificial Sequence
  Description of Artificial Sequence: Synthetic oligonucleotide
ctggaagacaggcgggccgtggt

SEQ ID NO: 417835 - DNA, 23 bp, Artificial Sequence
  Description of Artificial Sequence: Synthetic oligonucleotide
tggaagacaggcgggccgtggtg

SEQ ID NO: 417836 - DNA, 22 bp, Artificial Sequence
  Description of Artificial Sequence: Synthetic oligonucleotide
ggaagacaggcgggccgtggtg

SEQ ID NO: 417837 - DNA, 23 bp, Artificial Sequence
  Description of Artificial Sequence: Synthetic oligonucleotide
gaagacaggcgggccgtggtgga

SEQ ID NO: 417838 - DNA, 24 bp, Artificial Sequence
  Description of Artificial Sequence: Synthetic oligonucleotide
aagacaggcgggccgtggtggaca

SEQ ID NO: 417839 - DNA, 23 bp, Artificial Sequence
  Description of Artificial Sequence: Synthetic oligonucleotide
agacaggcgggccgtggtggaca

SEQ ID NO: 417840 - DNA, 22 bp, Artificial Sequence
  Description of Artificial Sequence: Synthetic oligonucleotide
gacaggcgggccgtggtggaca

SEQ ID NO: 417841 - DNA, 22 bp, Artificial Sequence
  Description of Artificial Sequence: Synthetic oligonucleotide
acaggcgggccgtggtggacac

SEQ ID NO: 417842 - DNA, 21 bp, Artificial Sequence
  Description of Artificial Sequence: Synthetic oligonucleotide
caggcgggccgtggtggacac

SEQ ID NO: 417843 - DNA, 23 bp, Artificial Sequence
  Description of Artificial Sequence: Synthetic oligonucleotide
aggcgggccgtggtggacaccta

SEQ ID NO: 417844 - DNA, 22 bp, Artificial Sequence
  Description of Artificial Sequence: Synthetic oligonucleotide
ggcgggccgtggtggacaccta

SEQ ID NO: 417845 - DNA, 23 bp, Artificial Sequence
  Description of Artificial Sequence: Synthetic oligonucleotide
gcgggccgtggtggacacctact

SEQ ID NO: 417846 - DNA, 23 bp, Artificial Sequence
  Description of Artificial Sequence: Synthetic oligonucleotide
cgggccgtggtggacacctactg

SEQ ID NO: 417847 - DNA, 24 bp, Artificial Sequence
  Description of Artificial Sequence: Synthetic oligonucleotide
gggccgtggtggacacctactgca

SEQ ID NO: 417848 - DNA, 25 bp, Artificial Sequence
  Description of Artificial Sequence: Synthetic oligonucleotide
ggccgtggtggacacctactgcaga

SEQ ID NO: 417849 - DNA, 26 bp, Artificial Sequence
  Description of Artificial Sequence: Synthetic oligonucleotide
gccgtggtggacacctactgcagaca

SEQ ID NO: 417850 - DNA, 27 bp, Artificial Sequence
  Description of Artificial Sequence: Synthetic oligonucleotide
ccgtggtggacacctactgcagacaca

SEQ ID NO: 417851 - DNA, 28 bp, Artificial Sequence
  Description of Artificial Sequence: Synthetic oligonucleotide
cgtggtggacacctactgcagacacaac

SEQ ID NO: 417852 - DNA, 30 bp, Artificial Sequence; identical to SEQ ID NO: 70441
  Description of Artificial Sequence: Synthetic oligonucleotide

SEQ ID NO: 417853 - DNA, 32 bp, Artificial Sequence; identical to SEQ ID NO: 70442
  Description of Artificial Sequence: Synthetic oligonucleotide

SEQ ID NO: 417854 - DNA, 31 bp, Artificial Sequence; identical to SEQ ID NO: 70443
  Description of Artificial Sequence: Synthetic oligonucleotide

SEQ ID NO: 417855 - DNA, 30 bp, Artificial Sequence; identical to SEQ ID NO: 70444
  Description of Artificial Sequence: Synthetic oligonucleotide

SEQ ID NO: 417856 - DNA, 30 bp, Artificial Sequence; identical to SEQ ID NO: 70445
  Description of Artificial Sequence: Synthetic oligonucleotide

SEQ ID NO: 417857 - DNA, 29 bp, Artificial Sequence
  Description of Artificial Sequence: Synthetic oligonucleotide
ggactactggaacagccagaaggacttcc

SEQ ID NO: 417858 - DNA, 30 bp, Artificial Sequence; identical to SEQ ID NO: 70447
  Description of Artificial Sequence: Synthetic oligonucleotide

SEQ ID NO: 417859 - DNA, 30 bp, Artificial Sequence; identical to SEQ ID NO: 70448
  Description of Artificial Sequence: Synthetic oligonucleotide

SEQ ID NO: 417860 - DNA, 29 bp, Artificial Sequence
  Description of Artificial Sequence: Synthetic oligonucleotide
ctactggaacagccagaaggacttcctgg

SEQ ID NO: 417861 - DNA, 22 bp, Artificial Sequence
  Description of Artificial Sequence: Synthetic oligonucleotide
gagctggggcggcctgatgagg

SEQ ID NO: 417862 - DNA, 22 bp, Artificial Sequence
  Description of Artificial Sequence: Synthetic oligonucleotide
agctggggcggcctgatgaggg

SEQ ID NO: 417863 - DNA, 21 bp, Artificial Sequence
  Description of Artificial Sequence: Synthetic oligonucleotide
gctggggcggcctgatgaggg

SEQ ID NO: 417864 - DNA, 23 bp, Artificial Sequence
  Description of Artificial Sequence: Synthetic oligonucleotide
ctggggcggcctgatgaggggta

SEQ ID NO: 417865 - DNA, 24 bp, Artificial Sequence
  Description of Artificial Sequence: Synthetic oligonucleotide
tggggcggcctgatgaggggtact

SEQ ID NO: 417866 - DNA, 23 bp, Artificial Sequence
  Description of Artificial Sequence: Synthetic oligonucleotide
ggggcggcctgatgaggggtact

SEQ ID NO: 417867 - DNA, 23 bp, Artificial Sequence
  Description of Artificial Sequence: Synthetic oligonucleotide
gggcggcctgatgaggggtactg

SEQ ID NO: 417868 - DNA, 25 bp, Artificial Sequence
  Description of Artificial Sequence: Synthetic oligonucleotide
ggcggcctgatgaggggtactggaa

SEQ ID NO: 417869 - DNA, 26 bp, Artificial Sequence
  Description of Artificial Sequence: Synthetic oligonucleotide
gcggcctgatgaggggtactggaaca

SEQ ID NO: 417870 - DNA, 26 bp, Artificial Sequence
  Description of Artificial Sequence: Synthetic oligonucleotide
cggcctgatgaggggtactggaacag

SEQ ID NO: 417871 - DNA, 26 bp, Artificial Sequence
  Description of Artificial Sequence: Synthetic oligonucleotide
ggcctgatgaggggtactggaacagc

SEQ ID NO: 417872 - DNA, 27 bp, Artificial Sequence
  Description of Artificial Sequence: Synthetic oligonucleotide
gcctgatgaggggtactggaacagcca

SEQ ID NO: 417873 - DNA, 27 bp, Artificial Sequence
  Description of Artificial Sequence: Synthetic oligonucleotide
cctgatgaggggtactggaacagccag

SEQ ID NO: 417874 - DNA, 29 bp, Artificial Sequence
  Description of Artificial Sequence: Synthetic oligonucleotide
ctgatgaggggtactggaacagccagaag

SEQ ID NO: 417875 - DNA, 29 bp, Artificial Sequence
  Description of Artificial Sequence: Synthetic oligonucleotide
tgatgaggggtactggaacagccagaagg

SEQ ID NO: 417876 - DNA, 28 bp, Artificial Sequence
  Description of Artificial Sequence: Synthetic oligonucleotide
gatgaggggtactggaacagccagaagg

SEQ ID NO: 417877 - DNA, 29 bp, Artificial Sequence
  Description of Artificial Sequence: Synthetic oligonucleotide
atgaggggtactggaacagccagaaggac

SEQ ID NO: 417878 - DNA, 28 bp, Artificial Sequence
  Description of Artificial Sequence: Synthetic oligonucleotide
tgaggggtactggaacagccagaaggac

SEQ ID NO: 417879 - DNA, 27 bp, Artificial Sequence
  Description of Artificial Sequence: Synthetic oligonucleotide
gaggggtactggaacagccagaaggac

SEQ ID NO: 417880 - DNA, 29 bp, Artificial Sequence
  Description of Artificial Sequence: Synthetic oligonucleotide
aggggtactggaacagccagaaggacttc

SEQ ID NO: 417881 - DNA, 28 bp, Artificial Sequence
  Description of Artificial Sequence: Synthetic oligonucleotide
ggggtactggaacagccagaaggacttc

SEQ ID NO: 417882 - DNA, 28 bp, Artificial Sequence
  Description of Artificial Sequence: Synthetic oligonucleotide
gggtactggaacagccagaaggacttcc

SEQ ID NO: 417883 - DNA, 29 bp, Artificial Sequence
  Description of Artificial Sequence: Synthetic oligonucleotide
ggtactggaacagccagaaggacttcctg

SEQ ID NO: 417884 - DNA, 23 bp, Artificial Sequence
  Description of Artificial Sequence: Synthetic oligonucleotide
agggagctggggcggcctgatga

SEQ ID NO: 417885 - DNA, 22 bp, Artificial Sequence
  Description of Artificial Sequence: Synthetic oligonucleotide
gggagctggggcggcctgatga

SEQ ID NO: 417886 - DNA, 35 bp, Artificial Sequence; identical to SEQ ID NO: 70475
  Description of Artificial Sequence: Synthetic oligonucleotide

SEQ ID NO: 417887 - DNA, 35 bp, Artificial Sequence; identical to SEQ ID NO: 70476
  Description of Artificial Sequence: Synthetic oligonucleotide

SEQ ID NO: 417888 - DNA, 34 bp, Artificial Sequence; identical to SEQ ID NO: 70477
  Description of Artificial Sequence: Synthetic oligonucleotide

SEQ ID NO: 417889 - DNA, 34 bp, Artificial Sequence; identical to SEQ ID NO: 70478
  Description of Artificial Sequence: Synthetic oligonucleotide

SEQ ID NO: 417890 - DNA, 34 bp, Artificial Sequence; identical to SEQ ID NO: 70479
  Description of Artificial Sequence: Synthetic oligonucleotide

SEQ ID NO: 417891 - DNA, 33 bp, Artificial Sequence; identical to SEQ ID NO: 70480
  Description of Artificial Sequence: Synthetic oligonucleotide

SEQ ID NO: 417892 - DNA, 33 bp, Artificial Sequence; identical to SEQ ID NO: 70481
  Description of Artificial Sequence: Synthetic oligonucleotide

SEQ ID NO: 417893 - DNA, 32 bp, Artificial Sequence; identical to SEQ ID NO: 70482
  Description of Artificial Sequence: Synthetic oligonucleotide

SEQ ID NO: 417894 - DNA, 34 bp, Artificial Sequence; identical to SEQ ID NO: 70483
  Description of Artificial Sequence: Synthetic oligonucleotide

SEQ ID NO: 417895 - DNA, 33 bp, Artificial Sequence; identical to SEQ ID NO: 70484
  Description of Artificial Sequence: Synthetic oligonucleotide

SEQ ID NO: 417896 - DNA, 32 bp, Artificial Sequence; identical to SEQ ID NO: 70485
  Description of Artificial Sequence: Synthetic oligonucleotide

SEQ ID NO: 417897 - DNA, 31 bp, Artificial Sequence; identical to SEQ ID NO: 70486
  Description of Artificial Sequence: Synthetic oligonucleotide

SEQ ID NO: 417898 - DNA, 31 bp, Artificial Sequence; identical to SEQ ID NO: 70487
  Description of Artificial Sequence: Synthetic oligonucleotide

SEQ ID NO: 417899 - DNA, 30 bp, Artificial Sequence; identical to SEQ ID NO: 70488
  Description of Artificial Sequence: Synthetic oligonucleotide

SEQ ID NO: 417900 - DNA, 29 bp, Artificial Sequence
  Description of Artificial Sequence: Synthetic oligonucleotide
ctataaccaagaggagtacgcgcgcttcg

SEQ ID NO: 417901 - DNA, 30 bp, Artificial Sequence; identical to SEQ ID NO: 70490
  Description of Artificial Sequence: Synthetic oligonucleotide

SEQ ID NO: 417902 - DNA, 28 bp, Artificial Sequence
  Description of Artificial Sequence: Synthetic oligonucleotide
ccagaaggacttcctggaagacaggcag

SEQ ID NO: 417903 - DNA, 28 bp, Artificial Sequence
  Description of Artificial Sequence: Synthetic oligonucleotide
cagaaggacttcctggaagacaggcagg

SEQ ID NO: 417904 - DNA, 28 bp, Artificial Sequence
  Description of Artificial Sequence: Synthetic oligonucleotide
agaaggacttcctggaagacaggcaggc

SEQ ID NO: 417905 - DNA, 27 bp, Artificial Sequence
  Description of Artificial Sequence: Synthetic oligonucleotide
gaaggacttcctggaagacaggcaggc

SEQ ID NO: 417906 - DNA, 27 bp, Artificial Sequence
  Description of Artificial Sequence: Synthetic oligonucleotide
aaggacttcctggaagacaggcaggcc

SEQ ID NO: 417907 - DNA, 26 bp, Artificial Sequence
  Description of Artificial Sequence: Synthetic oligonucleotide
aggacttcctggaagacaggcaggcc

SEQ ID NO: 417908 - DNA, 25 bp, Artificial Sequence
  Description of Artificial Sequence: Synthetic oligonucleotide
ggacttcctggaagacaggcaggcc

SEQ ID NO: 417909 - DNA, 25 bp, Artificial Sequence
  Description of Artificial Sequence: Synthetic oligonucleotide
gacttcctggaagacaggcaggccg

SEQ ID NO: 417910 - DNA, 25 bp, Artificial Sequence
  Description of Artificial Sequence: Synthetic oligonucleotide
acttcctggaagacaggcaggccgc

SEQ ID NO: 417911 - DNA, 24 bp, Artificial Sequence
  Description of Artificial Sequence: Synthetic oligonucleotide
cttcctggaagacaggcaggccgc

SEQ ID NO: 417912 - DNA, 24 bp, Artificial Sequence
  Description of Artificial Sequence: Synthetic oligonucleotide
ttcctggaagacaggcaggccgcg

SEQ ID NO: 417913 - DNA, 23 bp, Artificial Sequence
  Description of Artificial Sequence: Synthetic oligonucleotide
tcctggaagacaggcaggccgcg

SEQ ID NO: 417914 - DNA, 22 bp, Artificial Sequence
  Description of Artificial Sequence: Synthetic oligonucleotide
cctggaagacaggcaggccgcg

SEQ ID NO: 417915 - DNA, 23 bp, Artificial Sequence
  Description of Artificial Sequence: Synthetic oligonucleotide
ctggaagacaggcaggccgcggt

SEQ ID NO: 417916 - DNA, 23 bp, Artificial Sequence
  Description of Artificial Sequence: Synthetic oligonucleotide
tggaagacaggcaggccgcggtg

SEQ ID NO: 417917 - DNA, 22 bp, Artificial Sequence
  Description of Artificial Sequence: Synthetic oligonucleotide
ggaagacaggcaggccgcggtg

SEQ ID NO: 417918 - DNA, 23 bp, Artificial Sequence
  Description of Artificial Sequence: Synthetic oligonucleotide
gaagacaggcaggccgcggtgga

SEQ ID NO: 417919 - DNA, 24 bp, Artificial Sequence
  Description of Artificial Sequence: Synthetic oligonucleotide
aagacaggcaggccgcggtggaca

SEQ ID NO: 417920 - DNA, 23 bp, Artificial Sequence
  Description of Artificial Sequence: Synthetic oligonucleotide
agacaggcaggccgcggtggaca

SEQ ID NO: 417921 - DNA, 22 bp, Artificial Sequence
  Description of Artificial Sequence: Synthetic oligonucleotide
gacaggcaggccgcggtggaca

SEQ ID NO: 417922 - DNA, 22 bp, Artificial Sequence
  Description of Artificial Sequence: Synthetic oligonucleotide
acaggcaggccgcggtggacac

SEQ ID NO: 417923 - DNA, 21 bp, Artificial Sequence
  Description of Artificial Sequence: Synthetic oligonucleotide
caggcaggccgcggtggacac

SEQ ID NO: 417924 - DNA, 27 bp, Artificial Sequence
  Description of Artificial Sequence: Synthetic oligonucleotide
aggagcactggaacagccagaaggacc

SEQ ID NO: 417925 - DNA, 25 bp, Artificial Sequence
  Description of Artificial Sequence: Synthetic oligonucleotide
acttcctggagcagaagcggggcca

SEQ ID NO: 417926 - DNA, 24 bp, Artificial Sequence
  Description of Artificial Sequence: Synthetic oligonucleotide
cttcctggagcagaagcggggcca

SEQ ID NO: 417927 - DNA, 24 bp, Artificial Sequence
  Description of Artificial Sequence: Synthetic oligonucleotide
ttcctggagcagaagcggggccag

SEQ ID NO: 417928 - DNA, 24 bp, Artificial Sequence
  Description of Artificial Sequence: Synthetic oligonucleotide
agcagaagcggggccaggtggaca

SEQ ID NO: 417929 - DNA, 23 bp, Artificial Sequence
  Description of Artificial Sequence: Synthetic oligonucleotide
gcagaagcggggccaggtggaca

SEQ ID NO: 417930 - DNA, 23 bp, Artificial Sequence
  Description of Artificial Sequence: Synthetic oligonucleotide
cagaagcggggccaggtggacac

SEQ ID NO: 417931 - DNA, 25 bp, Artificial Sequence
  Description of Artificial Sequence: Synthetic oligonucleotide
agaagcggggccaggtggacaccta

SEQ ID NO: 417932 - DNA, 24 bp, Artificial Sequence
  Description of Artificial Sequence: Synthetic oligonucleotide
gaagcggggccaggtggacaccta

SEQ ID NO: 417933 - DNA, 25 bp, Artificial Sequence
  Description of Artificial Sequence: Synthetic oligonucleotide
aagcggggccaggtggacacctact

SEQ ID NO: 417934 - DNA, 24 bp, Artificial Sequence
  Description of Artificial Sequence: Synthetic oligonucleotide
agcggggccaggtggacacctact

SEQ ID NO: 417935 - DNA, 25 bp, Artificial Sequence
  Description of Artificial Sequence: Synthetic oligonucleotide
acttcctggaagacaggcgggccga

SEQ ID NO: 417936 - DNA, 24 bp, Artificial Sequence
  Description of Artificial Sequence: Synthetic oligonucleotide
cttcctggaagacaggcgggccga

SEQ ID NO: 417937 - DNA, 24 bp, Artificial Sequence
  Description of Artificial Sequence: Synthetic oligonucleotide
ttcctggaagacaggcgggccgag

SEQ ID NO: 417938 - DNA, 25 bp, Artificial Sequence
  Description of Artificial Sequence: Synthetic oligonucleotide
acttcctggaagacgagcgggccct

SEQ ID NO: 417939 - DNA, 24 bp, Artificial Sequence
  Description of Artificial Sequence: Synthetic oligonucleotide
cttcctggaagacgagcgggccct

SEQ ID NO: 417940 - DNA, 24 bp, Artificial Sequence
  Description of Artificial Sequence: Synthetic oligonucleotide
ttcctggaagacgagcgggccctg

SEQ ID NO: 417941 - DNA, 23 bp, Artificial Sequence
  Description of Artificial Sequence: Synthetic oligonucleotide
tcctggaagacgagcgggccctg

SEQ ID NO: 417942 - DNA, 22 bp, Artificial Sequence
  Description of Artificial Sequence: Synthetic oligonucleotide
cctggaagacgagcgggccctg

SEQ ID NO: 417943 - DNA, 23 bp, Artificial Sequence
  Description of Artificial Sequence: Synthetic oligonucleotide
ctggaagacgagcgggccctggt

SEQ ID NO: 417944 - DNA, 23 bp, Artificial Sequence
  Description of Artificial Sequence: Synthetic oligonucleotide
tggaagacgagcgggccctggtg

SEQ ID NO: 417945 - DNA, 22 bp, Artificial Sequence
  Description of Artificial Sequence: Synthetic oligonucleotide
ggaagacgagcgggccctggtg

SEQ ID NO: 417946 - DNA, 23 bp, Artificial Sequence
  Description of Artificial Sequence: Synthetic oligonucleotide
gaagacgagcgggccctggtgga

SEQ ID NO: 417947 - DNA, 24 bp, Artificial Sequence
  Description of Artificial Sequence: Synthetic oligonucleotide
aagacgagcgggccctggtggaca

SEQ ID NO: 417948 - DNA, 23 bp, Artificial Sequence
  Description of Artificial Sequence: Synthetic oligonucleotide
agacgagcgggccctggtggaca

SEQ ID NO: 417949 - DNA, 22 bp, Artificial Sequence
  Description of Artificial Sequence: Synthetic oligonucleotide
gacgagcgggccctggtggaca

SEQ ID NO: 417950 - DNA, 22 bp, Artificial Sequence
  Description of Artificial Sequence: Synthetic oligonucleotide
acgagcgggccctggtggacac

SEQ ID NO: 417951 - DNA, 21 bp, Artificial Sequence
  Description of Artificial Sequence: Synthetic oligonucleotide
cgagcgggccctggtggacac

SEQ ID NO: 417952 - DNA, 23 bp, Artificial Sequence
  Description of Artificial Sequence: Synthetic oligonucleotide
gagcgggccctggtggacaccta

SEQ ID NO: 417953 - DNA, 24 bp, Artificial Sequence
  Description of Artificial Sequence: Synthetic oligonucleotide
agcgggccctggtggacacctact

SEQ ID NO: 417954 - DNA, 37 bp, Artificial Sequence; identical to SEQ ID NO: 70579
  Description of Artificial Sequence: Synthetic oligonucleotide

SEQ ID NO: 417955 - DNA, 36 bp, Artificial Sequence; identical to SEQ ID NO: 70580
  Description of Artificial Sequence: Synthetic oligonucleotide

SEQ ID NO: 417956 - DNA, 35 bp, Artificial Sequence; identical to SEQ ID NO: 70581
  Description of Artificial Sequence: Synthetic oligonucleotide

SEQ ID NO: 417957 - DNA, 34 bp, Artificial Sequence; identical to SEQ ID NO: 70582
  Description of Artificial Sequence: Synthetic oligonucleotide

SEQ ID NO: 417958 - DNA, 35 bp, Artificial Sequence; identical to SEQ ID NO: 70583
  Description of Artificial Sequence: Synthetic oligonucleotide

SEQ ID NO: 417959 - DNA, 34 bp, Artificial Sequence; identical to SEQ ID NO: 70584
  Description of Artificial Sequence: Synthetic oligonucleotide

SEQ ID NO: 417960 - DNA, 33 bp, Artificial Sequence; identical to SEQ ID NO: 70585
  Description of Artificial Sequence: Synthetic oligonucleotide

SEQ ID NO: 417961 - DNA, 33 bp, Artificial Sequence; identical to SEQ ID NO: 70586
  Description of Artificial Sequence: Synthetic oligonucleotide

SEQ ID NO: 417962 - DNA, 32 bp, Artificial Sequence; identical to SEQ ID NO: 70587
  Description of Artificial Sequence: Synthetic oligonucleotide

SEQ ID NO: 417963 - DNA, 31 bp, Artificial Sequence; identical to SEQ ID NO: 70588
  Description of Artificial Sequence: Synthetic oligonucleotide

SEQ ID NO: 417964 - DNA, 30 bp, Artificial Sequence; identical to SEQ ID NO: 70589
  Description of Artificial Sequence: Synthetic oligonucleotide

SEQ ID NO: 417965 - DNA, 26 bp, Artificial Sequence
  Description of Artificial Sequence: Synthetic oligonucleotide
cgcttcaacagcgacgtgggggagtt

SEQ ID NO: 417966 - DNA, 26 bp, Artificial Sequence
  Description of Artificial Sequence: Synthetic oligonucleotide
gcttcaacagcgacgtgggggagttc

SEQ ID NO: 417967 - DNA, 26 bp, Artificial Sequence
  Description of Artificial Sequence: Synthetic oligonucleotide
cttcaacagcgacgtgggggagttcc

SEQ ID NO: 417968 - DNA, 26 bp, Artificial Sequence
  Description of Artificial Sequence: Synthetic oligonucleotide
ttcaacagcgacgtgggggagttccg

SEQ ID NO: 417969 - DNA, 25 bp, Artificial Sequence
  Description of Artificial Sequence: Synthetic oligonucleotide
tcaacagcgacgtgggggagttccg

SEQ ID NO: 417970 - DNA, 24 bp, Artificial Sequence
  Description of Artificial Sequence: Synthetic oligonucleotide
caacagcgacgtgggggagttccg

SEQ ID NO: 417971 - DNA, 24 bp, Artificial Sequence
  Description of Artificial Sequence: Synthetic oligonucleotide
aacagcgacgtgggggagttccgg

SEQ ID NO: 417972 - DNA, 23 bp, Artificial Sequence
  Description of Artificial Sequence: Synthetic oligonucleotide
gtgggggagttccgggcggtgat

SEQ ID NO: 417973 - DNA, 23 bp, Artificial Sequence
  Description of Artificial Sequence: Synthetic oligonucleotide
tgggggagttccgggcggtgatg

SEQ ID NO: 417974 - DNA, 22 bp, Artificial Sequence
  Description of Artificial Sequence: Synthetic oligonucleotide
gggggagttccgggcggtgatg

SEQ ID NO: 417975 - DNA, 23 bp, Artificial Sequence
  Description of Artificial Sequence: Synthetic oligonucleotide
ggggagttccgggcggtgatgga

SEQ ID NO: 417976 - DNA, 23 bp, Artificial Sequence
  Description of Artificial Sequence: Synthetic oligonucleotide
gggagttccgggcggtgatggag

SEQ ID NO: 417977 - DNA, 24 bp, Artificial Sequence
  Description of Artificial Sequence: Synthetic oligonucleotide
ggagttccgggcggtgatggagct

SEQ ID NO: 417978 - DNA, 24 bp, Artificial Sequence
  Description of Artificial Sequence: Synthetic oligonucleotide
gagttccgggcggtgatggagctg

SEQ ID NO: 417979 - DNA, 24 bp, Artificial Sequence
  Description of Artificial Sequence: Synthetic oligonucleotide
agttccgggcggtgatggagctgg

SEQ ID NO: 417980 - DNA, 23 bp, Artificial Sequence
  Description of Artificial Sequence: Synthetic oligonucleotide
gttccgggcggtgatggagctgg

SEQ ID NO: 417981 - DNA, 23 bp, Artificial Sequence
  Description of Artificial Sequence: Synthetic oligonucleotide
ttccgggcggtgatggagctggg

SEQ ID NO: 417982 - DNA, 22 bp, Artificial Sequence
  Description of Artificial Sequence: Synthetic oligonucleotide
tccgggcggtgatggagctggg

SEQ ID NO: 417983 - DNA, 25 bp, Artificial Sequence
  Description of Artificial Sequence: Synthetic oligonucleotide
tgatggagctggggcggcctgatga

SEQ ID NO: 417984 - DNA, 24 bp, Artificial Sequence
  Description of Artificial Sequence: Synthetic oligonucleotide
gatggagctggggcggcctgatga

SEQ ID NO: 417985 - DNA, 24 bp, Artificial Sequence
  Description of Artificial Sequence: Synthetic oligonucleotide
atggagctggggcggcctgatgag

SEQ ID NO: 417986 - DNA, 23 bp, Artificial Sequence
  Description of Artificial Sequence: Synthetic oligonucleotide
tggagctggggcggcctgatgag

SEQ ID NO: 417987 - DNA, 28 bp, Artificial Sequence
  Description of Artificial Sequence: Synthetic oligonucleotide
aacagccagaaggacttcctggagcagg

SEQ ID NO: 417988 - DNA, 27 bp, Artificial Sequence
  Description of Artificial Sequence: Synthetic oligonucleotide
acagccagaaggacttcctggagcagg

SEQ ID NO: 417989 - DNA, 26 bp, Artificial Sequence
  Description of Artificial Sequence: Synthetic oligonucleotide
cagccagaaggacttcctggagcagg

SEQ ID NO: 417990 - DNA, 26 bp, Artificial Sequence
  Description of Artificial Sequence: Synthetic oligonucleotide
agccagaaggacttcctggagcaggc

SEQ ID NO: 417991 - DNA, 25 bp, Artificial Sequence
  Description of Artificial Sequence: Synthetic oligonucleotide
gccagaaggacttcctggagcaggc

SEQ ID NO: 417992 - DNA, 25 bp, Artificial Sequence
  Description of Artificial Sequence: Synthetic oligonucleotide
ccagaaggacttcctggagcaggcg

SEQ ID NO: 417993 - DNA, 25 bp, Artificial Sequence
  Description of Artificial Sequence: Synthetic oligonucleotide
cagaaggacttcctggagcaggcgc

SEQ ID NO: 417994 - DNA, 25 bp, Artificial Sequence
  Description of Artificial Sequence: Synthetic oligonucleotide
agaaggacttcctggagcaggcgcg

SEQ ID NO: 417995 - DNA, 24 bp, Artificial Sequence
  Description of Artificial Sequence: Synthetic oligonucleotide
gaaggacttcctggagcaggcgcg

SEQ ID NO: 417996 - DNA, 24 bp, Artificial Sequence
  Description of Artificial Sequence: Synthetic oligonucleotide
aaggacttcctggagcaggcgcgg

SEQ ID NO: 417997 - DNA, 23 bp, Artificial Sequence
  Description of Artificial Sequence: Synthetic oligonucleotide
aggacttcctggagcaggcgcgg

SEQ ID NO: 417998 - DNA, 22 bp, Artificial Sequence
  Description of Artificial Sequence: Synthetic oligonucleotide
ggacttcctggagcaggcgcgg

SEQ ID NO: 417999 - DNA, 22 bp, Artificial Sequence
  Description of Artificial Sequence: Synthetic oligonucleotide
gacttcctggagcaggcgcggg

SEQ ID NO: 418000 - DNA, 22 bp, Artificial Sequence
  Description of Artificial Sequence: Synthetic oligonucleotide
acttcctggagcaggcgcgggc

SEQ ID NO: 418001 - DNA, 21 bp, Artificial Sequence
  Description of Artificial Sequence: Synthetic oligonucleotide
cttcctggagcaggcgcgggc

SEQ ID NO: 418002 - DNA, 21 bp, Artificial Sequence
  Description of Artificial Sequence: Synthetic oligonucleotide
ttcctggagcaggcgcgggcc

SEQ ID NO: 418003 - DNA, 25 bp, Artificial Sequence
  Description of Artificial Sequence: Synthetic oligonucleotide
acatcctggaagacgagcgggccgt

SEQ ID NO: 418004 - DNA, 24 bp, Artificial Sequence
  Description of Artificial Sequence: Synthetic oligonucleotide
catcctggaagacgagcgggccgt

SEQ ID NO: 418005 - DNA, 24 bp, Artificial Sequence
  Description of Artificial Sequence: Synthetic oligonucleotide
atcctggaagacgagcgggccgtg

SEQ ID NO: 418006 - DNA, 23 bp, Artificial Sequence
  Description of Artificial Sequence: Synthetic oligonucleotide
tcctggaagacgagcgggccgtg

SEQ ID NO: 418007 - DNA, 22 bp, Artificial Sequence
  Description of Artificial Sequence: Synthetic oligonucleotide
cctggaagacgagcgggccgtg

SEQ ID NO: 418008 - DNA, 23 bp, Artificial Sequence
  Description of Artificial Sequence: Synthetic oligonucleotide
ctggaagacgagcgggccgtggt

SEQ ID NO: 418009 - DNA, 23 bp, Artificial Sequence
  Description of Artificial Sequence: Synthetic oligonucleotide
tggaagacgagcgggccgtggtg

SEQ ID NO: 418010 - DNA, 22 bp, Artificial Sequence
  Description of Artificial Sequence: Synthetic oligonucleotide
ggaagacgagcgggccgtggtg

SEQ ID NO: 418011 - DNA, 23 bp, Artificial Sequence
  Description of Artificial Sequence: Synthetic oligonucleotide
gaagacgagcgggccgtggtgga

SEQ ID NO: 418012 - DNA, 24 bp, Artificial Sequence
  Description of Artificial Sequence: Synthetic oligonucleotide
aagacgagcgggccgtggtggaca

SEQ ID NO: 418013 - DNA, 23 bp, Artificial Sequence
  Description of Artificial Sequence: Synthetic oligonucleotide
agacgagcgggccgtggtggaca

SEQ ID NO: 418014 - DNA, 22 bp, Artificial Sequence
  Description of Artificial Sequence: Synthetic oligonucleotide
gacgagcgggccgtggtggaca

SEQ ID NO: 418015 - DNA, 22 bp, Artificial Sequence
  Description of Artificial Sequence: Synthetic oligonucleotide
acgagcgggccgtggtggacac

SEQ ID NO: 418016 - DNA, 21 bp, Artificial Sequence
  Description of Artificial Sequence: Synthetic oligonucleotide
cgagcgggccgtggtggacac

SEQ ID NO: 418017 - DNA, 23 bp, Artificial Sequence
  Description of Artificial Sequence: Synthetic oligonucleotide
gagcgggccgtggtggacaccta

SEQ ID NO: 418018 - DNA, 24 bp, Artificial Sequence
  Description of Artificial Sequence: Synthetic oligonucleotide
agcgggccgtggtggacacctact

SEQ ID NO: 418019 - DNA, 30 bp, Artificial Sequence; identical to SEQ ID NO: 70661
  Description of Artificial Sequence: Synthetic oligonucleotide

SEQ ID NO: 418020 - DNA, 30 bp, Artificial Sequence; identical to SEQ ID NO: 70662
  Description of Artificial Sequence: Synthetic oligonucleotide

SEQ ID NO: 418021 - DNA, 29 bp, Artificial Sequence
  Description of Artificial Sequence: Synthetic oligonucleotide
ggacacctactgcagacacaactacgagg

SEQ ID NO: 418022 - DNA, 31 bp, Artificial Sequence; identical to SEQ ID NO: 70664
  Description of Artificial Sequence: Synthetic oligonucleotide

SEQ ID NO: 418023 - DNA, 31 bp, Artificial Sequence; identical to SEQ ID NO: 70665
  Description of Artificial Sequence: Synthetic oligonucleotide

SEQ ID NO: 418024 - DNA, 30 bp, Artificial Sequence; identical to SEQ ID NO: 70666
  Description of Artificial Sequence: Synthetic oligonucleotide

SEQ ID NO: 418025 - DNA, 31 bp, Artificial Sequence; identical to SEQ ID NO: 70667
  Description of Artificial Sequence: Synthetic oligonucleotide

SEQ ID NO: 418026 - DNA, 30 bp, Artificial Sequence; identical to SEQ ID NO: 70668
  Description of Artificial Sequence: Synthetic oligonucleotide

SEQ ID NO: 418027 - DNA, 31 bp, Artificial Sequence; identical to SEQ ID NO: 70669
  Description of Artificial Sequence: Synthetic oligonucleotide

SEQ ID NO: 418028 - DNA, 32 bp, Artificial Sequence; identical to SEQ ID NO: 70670
  Description of Artificial Sequence: Synthetic oligonucleotide

SEQ ID NO: 418029 - DNA, 31 bp, Artificial Sequence; identical to SEQ ID NO: 70671
  Description of Artificial Sequence: Synthetic oligonucleotide

SEQ ID NO: 418030 - DNA, 30 bp, Artificial Sequence; identical to SEQ ID NO: 70672
  Description of Artificial Sequence: Synthetic oligonucleotide

SEQ ID NO: 418031 - DNA, 30 bp, Artificial Sequence; identical to SEQ ID NO: 70673
  Description of Artificial Sequence: Synthetic oligonucleotide

SEQ ID NO: 418032 - DNA, 29 bp, Artificial Sequence
  Description of Artificial Sequence: Synthetic oligonucleotide
gcagacacaactacgaggttggtgagagc

SEQ ID NO: 418033 - DNA, 31 bp, Artificial Sequence; identical to SEQ ID NO: 70675
  Description of Artificial Sequence: Synthetic oligonucleotide

SEQ ID NO: 418034 - DNA, 32 bp, Artificial Sequence; identical to SEQ ID NO: 70676
  Description of Artificial Sequence: Synthetic oligonucleotide

SEQ ID NO: 418035 - DNA, 31 bp, Artificial Sequence; identical to SEQ ID NO: 70677
  Description of Artificial Sequence: Synthetic oligonucleotide

SEQ ID NO: 418036 - DNA, 32 bp, Artificial Sequence; identical to SEQ ID NO: 70678
  Description of Artificial Sequence: Synthetic oligonucleotide

SEQ ID NO: 418037 - DNA, 31 bp, Artificial Sequence; identical to SEQ ID NO: 70679
  Description of Artificial Sequence: Synthetic oligonucleotide

SEQ ID NO: 418038 - DNA, 32 bp, Artificial Sequence; identical to SEQ ID NO: 70680
  Description of Artificial Sequence: Synthetic oligonucleotide

SEQ ID NO: 418039 - DNA, 31 bp, Artificial Sequence; identical to SEQ ID NO: 70681
  Description of Artificial Sequence: Synthetic oligonucleotide

SEQ ID NO: 418040 - DNA, 31 bp, Artificial Sequence; identical to SEQ ID NO: 70682
  Description of Artificial Sequence: Synthetic oligonucleotide

SEQ ID NO: 418041 - DNA, 30 bp, Artificial Sequence; identical to SEQ ID NO: 70683
  Description of Artificial Sequence: Synthetic oligonucleotide

SEQ ID NO: 418042 - DNA, 29 bp, Artificial Sequence
  Description of Artificial Sequence: Synthetic oligonucleotide
ctacgaggttggtgagagcttcacagtgc

SEQ ID NO: 418043 - DNA, 30 bp, Artificial Sequence; identical to SEQ ID NO: 70685
  Description of Artificial Sequence: Synthetic oligonucleotide

SEQ ID NO: 418044 - DNA, 29 bp, Artificial Sequence
  Description of Artificial Sequence: Synthetic oligonucleotide
acgaggttggtgagagcttcacagtgcag

SEQ ID NO: 418045 - DNA, 28 bp, Artificial Sequence
  Description of Artificial Sequence: Synthetic oligonucleotide
cgaggttggtgagagcttcacagtgcag

SEQ ID NO: 418046 - DNA, 28 bp, Artificial Sequence
  Description of Artificial Sequence: Synthetic oligonucleotide
gaggttggtgagagcttcacagtgcagc

SEQ ID NO: 418047 - DNA, 28 bp, Artificial Sequence
  Description of Artificial Sequence: Synthetic oligonucleotide
aggttggtgagagcttcacagtgcagcg

SEQ ID NO: 418048 - DNA, 31 bp, Artificial Sequence
  Description of Artificial Sequence: Synthetic oligonucleotide
acacaactacgaggttggtgagagcttcacg

SEQ ID NO: 418049 - DNA, 30 bp, Artificial Sequence
  Description of Artificial Sequence: Synthetic oligonucleotide
cacaactacgaggttggtgagagcttcacg

SEQ ID NO: 418050 - DNA, 30 bp, Artificial Sequence
  Description of Artificial Sequence: Synthetic oligonucleotide
acaactacgaggttggtgagagcttcacgg

SEQ ID NO: 418051 - DNA, 29 bp, Artificial Sequence
  Description of Artificial Sequence: Synthetic oligonucleotide
caactacgaggttggtgagagcttcacgg

SEQ ID NO: 418052 - DNA, 30 bp, Artificial Sequence
  Description of Artificial Sequence: Synthetic oligonucleotide
aactacgaggttggtgagagcttcacggtg

SEQ ID NO: 418053 - DNA, 29 bp, Artificial Sequence
  Description of Artificial Sequence: Synthetic oligonucleotide
actacgaggttggtgagagcttcacggtg

SEQ ID NO: 418054 - DNA, 28 bp, Artificial Sequence
  Description of Artificial Sequence: Synthetic oligonucleotide
ctacgaggttggtgagagcttcacggtg

SEQ ID NO: 418055 - DNA, 28 bp, Artificial Sequence
  Description of Artificial Sequence: Synthetic oligonucleotide
tacgaggttggtgagagcttcacggtgc

SEQ ID NO: 418056 - DNA, 27 bp, Artificial Sequence
  Description of Artificial Sequence: Synthetic oligonucleotide
acgaggttggtgagagcttcacggtgc

SEQ ID NO: 418057 - DNA, 27 bp, Artificial Sequence
  Description of Artificial Sequence: Synthetic oligonucleotide
cgaggttggtgagagcttcacggtgca

SEQ ID NO: 418058 - DNA, 27 bp, Artificial Sequence
  Description of Artificial Sequence: Synthetic oligonucleotide
gaggttggtgagagcttcacggtgcag

SEQ ID NO: 418059 - DNA, 27 bp, Artificial Sequence
  Description of Artificial Sequence: Synthetic oligonucleotide
aggttggtgagagcttcacggtgcagc

SEQ ID NO: 418060 - DNA, 21 bp, Artificial Sequence
  Description of Artificial Sequence: Synthetic oligonucleotide
gtgggggagttccgggcggtg

SEQ ID NO: 418061 - DNA, 21 bp, Artificial Sequence
  Description of Artificial Sequence: Synthetic oligonucleotide
tgggggagttccgggcggtgg

SEQ ID NO: 418062 - DNA, 20 bp, Artificial Sequence
  Description of Artificial Sequence: Synthetic oligonucleotide
gggggagttccgggcggtgg

SEQ ID NO: 418063 - DNA, 20 bp, Artificial Sequence
  Description of Artificial Sequence: Synthetic oligonucleotide
ggggagttccgggcggtggc

SEQ ID NO: 418064 - DNA, 20 bp, Artificial Sequence
  Description of Artificial Sequence: Synthetic oligonucleotide
gggagttccgggcggtggcg

SEQ ID NO: 418065 - DNA, 21 bp, Artificial Sequence
  Description of Artificial Sequence: Synthetic oligonucleotide
ggagttccgggcggtggcgga

SEQ ID NO: 418066 - DNA, 21 bp, Artificial Sequence
  Description of Artificial Sequence: Synthetic oligonucleotide
gagttccgggcggtggcggag

SEQ ID NO: 418067 - DNA, 22 bp, Artificial Sequence
  Description of Artificial Sequence: Synthetic oligonucleotide
agttccgggcggtggcggagct

SEQ ID NO: 418068 - DNA, 21 bp, Artificial Sequence
  Description of Artificial Sequence: Synthetic oligonucleotide
gttccgggcggtggcggagct

SEQ ID NO: 418069 - DNA, 21 bp, Artificial Sequence
  Description of Artificial Sequence: Synthetic oligonucleotide
ttccgggcggtggcggagctg

SEQ ID NO: 418070 - DNA, 20 bp, Artificial Sequence
  Description of Artificial Sequence: Synthetic oligonucleotide
tccgggcggtggcggagctg

SEQ ID NO: 418071 - DNA, 20 bp, Artificial Sequence
  Description of Artificial Sequence: Synthetic oligonucleotide
ccgggcggtggcggagctgt

SEQ ID NO: 418072 - DNA, 20 bp, Artificial Sequence
  Description of Artificial Sequence: Synthetic oligonucleotide
cgggcggtggcggagctggt

SEQ ID NO: 418073 - DNA, 20 bp, Artificial Sequence
  Description of Artificial Sequence: Synthetic oligonucleotide
gggcggtggcggagctgggt

SEQ ID NO: 418074 - DNA, 20 bp, Artificial Sequence
  Description of Artificial Sequence: Synthetic oligonucleotide
ggcggtggcggagctggggt

SEQ ID NO: 418075 - DNA, 20 bp, Artificial Sequence
  Description of Artificial Sequence: Synthetic oligonucleotide
gcggtggcggagctggggct

SEQ ID NO: 418076 - DNA, 20 bp, Artificial Sequence
  Description of Artificial Sequence: Synthetic oligonucleotide
cggtggcggagctggggcgt

SEQ ID NO: 418077 - DNA, 20 bp, Artificial Sequence
  Description of Artificial Sequence: Synthetic oligonucleotide
ggtggcggagctggggcggt

SEQ ID NO: 418078 - DNA, 20 bp, Artificial Sequence
  Description of Artificial Sequence: Synthetic oligonucleotide
gtggcggagctggggcggct

SEQ ID NO: 418079 - DNA, 20 bp, Artificial Sequence
  Description of Artificial Sequence: Synthetic oligonucleotide
tggcggagctggggcggcct

SEQ ID NO: 418080 - DNA, 20 bp, Artificial Sequence
  Description of Artificial Sequence: Synthetic oligonucleotide
ggcggagctggggcggcctt

SEQ ID NO: 418081 - DNA, 21 bp, Artificial Sequence
  Description of Artificial Sequence: Synthetic oligonucleotide
gcggagctggggcggcctgat

SEQ ID NO: 418082 - DNA, 37 bp, Artificial Sequence; identical to SEQ ID NO: 70712
  Description of Artificial Sequence: Synthetic oligonucleotide

SEQ ID NO: 418083 - DNA, 36 bp, Artificial Sequence; identical to SEQ ID NO: 70713
  Description of Artificial Sequence: Synthetic oligonucleotide

SEQ ID NO: 418084 - DNA, 35 bp, Artificial Sequence; identical to SEQ ID NO: 70714
  Description of Artificial Sequence: Synthetic oligonucleotide

SEQ ID NO: 418085 - DNA, 36 bp, Artificial Sequence; identical to SEQ ID NO: 70715
  Description of Artificial Sequence: Synthetic oligonucleotide

SEQ ID NO: 418086 - DNA, 36 bp, Artificial Sequence; identical to SEQ ID NO: 70716
  Description of Artificial Sequence: Synthetic oligonucleotide

SEQ ID NO: 418087 - DNA, 35 bp, Artificial Sequence; identical to SEQ ID NO: 70717
  Description of Artificial Sequence: Synthetic oligonucleotide

SEQ ID NO: 418088 - DNA, 35 bp, Artificial Sequence; identical to SEQ ID NO: 70718
  Description of Artificial Sequence: Synthetic oligonucleotide

SEQ ID NO: 418089 - DNA, 35 bp, Artificial Sequence; identical to SEQ ID NO: 70719
  Description of Artificial Sequence: Synthetic oligonucleotide

SEQ ID NO: 418090 - DNA, 34 bp, Artificial Sequence; identical to SEQ ID NO: 70720
  Description of Artificial Sequence: Synthetic oligonucleotide

SEQ ID NO: 418091 - DNA, 36 bp, Artificial Sequence; identical to SEQ ID NO: 70721
  Description of Artificial Sequence: Synthetic oligonucleotide

SEQ ID NO: 418092 - DNA, 35 bp, Artificial Sequence; identical to SEQ ID NO: 70722
  Description of Artificial Sequence: Synthetic oligonucleotide

SEQ ID NO: 418093 - DNA, 35 bp, Artificial Sequence; identical to SEQ ID NO: 70723
  Description of Artificial Sequence: Synthetic oligonucleotide

SEQ ID NO: 418094 - DNA, 34 bp, Artificial Sequence; identical to SEQ ID NO: 70724
  Description of Artificial Sequence: Synthetic oligonucleotide

SEQ ID NO: 418095 - DNA, 33 bp, Artificial Sequence; identical to SEQ ID NO: 70725
  Description of Artificial Sequence: Synthetic oligonucleotide

SEQ ID NO: 418096 - DNA, 32 bp, Artificial Sequence; identical to SEQ ID NO: 70726
  Description of Artificial Sequence: Synthetic oligonucleotide

SEQ ID NO: 418097 - DNA, 33 bp, Artificial Sequence; identical to SEQ ID NO: 70727
  Description of Artificial Sequence: Synthetic oligonucleotide

SEQ ID NO: 418098 - DNA, 32 bp, Artificial Sequence; identical to SEQ ID NO: 70728
  Description of Artificial Sequence: Synthetic oligonucleotide

SEQ ID NO: 418099 - DNA, 31 bp, Artificial Sequence; identical to SEQ ID NO: 70729
  Description of Artificial Sequence: Synthetic oligonucleotide

SEQ ID NO: 418100 - DNA, 32 bp, Artificial Sequence; identical to SEQ ID NO: 70730
  Description of Artificial Sequence: Synthetic oligonucleotide

SEQ ID NO: 418101 - DNA, 31 bp, Artificial Sequence; identical to SEQ ID NO: 70731
  Description of Artificial Sequence: Synthetic oligonucleotide

SEQ ID NO: 418102 - DNA, 30 bp, Artificial Sequence; identical to SEQ ID NO: 70732
  Description of Artificial Sequence: Synthetic oligonucleotide

SEQ ID NO: 418103 - DNA, 29 bp, Artificial Sequence
  Description of Artificial Sequence: Synthetic oligonucleotide
aaccaagaggagtacctgcgcttcgacag

SEQ ID NO: 418104 - DNA, 28 bp, Artificial Sequence
  Description of Artificial Sequence: Synthetic oligonucleotide
accaagaggagtacctgcgcttcgacag

SEQ ID NO: 418105 - DNA, 27 bp, Artificial Sequence
  Description of Artificial Sequence: Synthetic oligonucleotide
ccaagaggagtacctgcgcttcgacag

SEQ ID NO: 418106 - DNA, 27 bp, Artificial Sequence
  Description of Artificial Sequence: Synthetic oligonucleotide
caagaggagtacctgcgcttcgacagc

SEQ ID NO: 418107 - DNA, 27 bp, Artificial Sequence
  Description of Artificial Sequence: Synthetic oligonucleotide
aagaggagtacctgcgcttcgacagcg

SEQ ID NO: 418108 - DNA, 27 bp, Artificial Sequence
  Description of Artificial Sequence: Synthetic oligonucleotide
agaggagtacctgcgcttcgacagcga

SEQ ID NO: 418109 - DNA, 26 bp, Artificial Sequence
  Description of Artificial Sequence: Synthetic oligonucleotide
gaggagtacctgcgcttcgacagcga

SEQ ID NO: 418110 - DNA, 26 bp, Artificial Sequence
  Description of Artificial Sequence: Synthetic oligonucleotide
aggagtacctgcgcttcgacagcgac

SEQ ID NO: 418111 - DNA, 25 bp, Artificial Sequence
  Description of Artificial Sequence: Synthetic oligonucleotide
ggagtacctgcgcttcgacagcgac

SEQ ID NO: 418112 - DNA, 26 bp, Artificial Sequence
  Description of Artificial Sequence: Synthetic oligonucleotide
gagtacctgcgcttcgacagcgacgt

SEQ ID NO: 418113 - DNA, 26 bp, Artificial Sequence
  Description of Artificial Sequence: Synthetic oligonucleotide
agtacctgcgcttcgacagcgacgtg

SEQ ID NO: 418114 - DNA, 25 bp, Artificial Sequence
  Description of Artificial Sequence: Synthetic oligonucleotide
gtacctgcgcttcgacagcgacgtg

SEQ ID NO: 418115 - DNA, 25 bp, Artificial Sequence
  Description of Artificial Sequence: Synthetic oligonucleotide
tacctgcgcttcgacagcgacgtgg

SEQ ID NO: 418116 - DNA, 24 bp, Artificial Sequence
  Description of Artificial Sequence: Synthetic oligonucleotide
acctgcgcttcgacagcgacgtgg

SEQ ID NO: 418117 - DNA, 27 bp, Artificial Sequence
  Description of Artificial Sequence: Synthetic oligonucleotide
cggtggacacctactgcagacacaacc

SEQ ID NO: 418118 - DNA, 28 bp, Artificial Sequence
  Description of Artificial Sequence: Synthetic oligonucleotide
ggtggacacctactgcagacacaaccac

SEQ ID NO: 418119 - DNA, 28 bp, Artificial Sequence
  Description of Artificial Sequence: Synthetic oligonucleotide
gtggacacctactgcagacacaaccacg

SEQ ID NO: 418120 - DNA, 28 bp, Artificial Sequence
  Description of Artificial Sequence: Synthetic oligonucleotide
tggacacctactgcagacacaaccacgg

SEQ ID NO: 418121 - DNA, 27 bp, Artificial Sequence
  Description of Artificial Sequence: Synthetic oligonucleotide
ggacacctactgcagacacaaccacgg

SEQ ID NO: 418122 - DNA, 27 bp, Artificial Sequence
  Description of Artificial Sequence: Synthetic oligonucleotide
gacacctactgcagacacaaccacggg

SEQ ID NO: 418123 - DNA, 27 bp, Artificial Sequence
  Description of Artificial Sequence: Synthetic oligonucleotide
acacctactgcagacacaaccacgggg

SEQ ID NO: 418124 - DNA, 27 bp, Artificial Sequence
  Description of Artificial Sequence: Synthetic oligonucleotide
cacctactgcagacacaaccacggggt

SEQ ID NO: 418125 - DNA, 28 bp, Artificial Sequence
  Description of Artificial Sequence: Synthetic oligonucleotide
acctactgcagacacaaccacggggttg

SEQ ID NO: 418126 - DNA, 27 bp, Artificial Sequence
  Description of Artificial Sequence: Synthetic oligonucleotide
cctactgcagacacaaccacggggttg

SEQ ID NO: 418127 - DNA, 28 bp, Artificial Sequence
  Description of Artificial Sequence: Synthetic oligonucleotide
ctactgcagacacaaccacggggttgtg

SEQ ID NO: 418128 - DNA, 28 bp, Artificial Sequence
  Description of Artificial Sequence: Synthetic oligonucleotide
tactgcagacacaaccacggggttgtgg

SEQ ID NO: 418129 - DNA, 27 bp, Artificial Sequence
  Description of Artificial Sequence: Synthetic oligonucleotide
actgcagacacaaccacggggttgtgg

SEQ ID NO: 418130 - DNA, 27 bp, Artificial Sequence
  Description of Artificial Sequence: Synthetic oligonucleotide
ctgcagacacaaccacggggttgtgga

SEQ ID NO: 418131 - DNA, 27 bp, Artificial Sequence
  Description of Artificial Sequence: Synthetic oligonucleotide
tgcagacacaaccacggggttgtggag

SEQ ID NO: 418132 - DNA, 27 bp, Artificial Sequence
  Description of Artificial Sequence: Synthetic oligonucleotide
gcagacacaaccacggggttgtggaga

SEQ ID NO: 418133 - DNA, 27 bp, Artificial Sequence
  Description of Artificial Sequence: Synthetic oligonucleotide
cagacacaaccacggggttgtggagag

SEQ ID NO: 418134 - DNA, 27 bp, Artificial Sequence
  Description of Artificial Sequence: Synthetic oligonucleotide
agacacaaccacggggttgtggagagc

SEQ ID NO: 418135 - DNA, 27 bp, Artificial Sequence
  Description of Artificial Sequence: Synthetic oligonucleotide
gacacaaccacggggttgtggagagct

SEQ ID NO: 418136 - DNA, 28 bp, Artificial Sequence
  Description of Artificial Sequence: Synthetic oligonucleotide
acacaaccacggggttgtggagagcttc

SEQ ID NO: 418137 - DNA, 27 bp, Artificial Sequence
  Description of Artificial Sequence: Synthetic oligonucleotide
cacaaccacggggttgtggagagcttc

SEQ ID NO: 418138 - DNA, 28 bp, Artificial Sequence
  Description of Artificial Sequence: Synthetic oligonucleotide
acaaccacggggttgtggagagcttcac

SEQ ID NO: 418139 - DNA, 27 bp, Artificial Sequence
  Description of Artificial Sequence: Synthetic oligonucleotide
caaccacggggttgtggagagcttcac

SEQ ID NO: 418140 - DNA, 28 bp, Artificial Sequence
  Description of Artificial Sequence: Synthetic oligonucleotide
aaccacggggttgtggagagcttcacag

SEQ ID NO: 418141 - DNA, 27 bp, Artificial Sequence
  Description of Artificial Sequence: Synthetic oligonucleotide
accacggggttgtggagagcttcacag

SEQ ID NO: 418142 - DNA, 27 bp, Artificial Sequence
  Description of Artificial Sequence: Synthetic oligonucleotide
ccacggggttgtggagagcttcacagt

SEQ ID NO: 418143 - DNA, 27 bp, Artificial Sequence
  Description of Artificial Sequence: Synthetic oligonucleotide
cacggggttgtggagagcttcacagtg

SEQ ID NO: 418144 - DNA, 39 bp, Artificial Sequence; identical to SEQ ID NO: 70774
  Description of Artificial Sequence: Synthetic oligonucleotide

SEQ ID NO: 418145 - DNA, 38 bp, Artificial Sequence; identical to SEQ ID NO: 70775
  Description of Artificial Sequence: Synthetic oligonucleotide

SEQ ID NO: 418146 - DNA, 37 bp, Artificial Sequence; identical to SEQ ID NO: 70776
  Description of Artificial Sequence: Synthetic oligonucleotide

SEQ ID NO: 418147 - DNA, 36 bp, Artificial Sequence; identical to SEQ ID NO: 70777
  Description of Artificial Sequence: Synthetic oligonucleotide

SEQ ID NO: 418148 - DNA, 37 bp, Artificial Sequence; identical to SEQ ID NO: 70778
  Description of Artificial Sequence: Synthetic oligonucleotide

SEQ ID NO: 418149 - DNA, 36 bp, Artificial Sequence; identical to SEQ ID NO: 70779
  Description of Artificial Sequence: Synthetic oligonucleotide

SEQ ID NO: 418150 - DNA, 35 bp, Artificial Sequence; identical to SEQ ID NO: 70780
  Description of Artificial Sequence: Synthetic oligonucleotide

SEQ ID NO: 418151 - DNA, 35 bp, Artificial Sequence; identical to SEQ ID NO: 70781
  Description of Artificial Sequence: Synthetic oligonucleotide

SEQ ID NO: 418152 - DNA, 35 bp, Artificial Sequence; identical to SEQ ID NO: 70782
  Description of Artificial Sequence: Synthetic oligonucleotide

SEQ ID NO: 418153 - DNA, 34 bp, Artificial Sequence; identical to SEQ ID NO: 70783
  Description of Artificial Sequence: Synthetic oligonucleotide

SEQ ID NO: 418154 - DNA, 35 bp, Artificial Sequence; identical to SEQ ID NO: 70784
  Description of Artificial Sequence: Synthetic oligonucleotide

SEQ ID NO: 418155 - DNA, 34 bp, Artificial Sequence; identical to SEQ ID NO: 70785
  Description of Artificial Sequence: Synthetic oligonucleotide

SEQ ID NO: 418156 - DNA, 33 bp, Artificial Sequence; identical to SEQ ID NO: 70786
  Description of Artificial Sequence: Synthetic oligonucleotide

SEQ ID NO: 418157 - DNA, 33 bp, Artificial Sequence; identical to SEQ ID NO: 70787
  Description of Artificial Sequence: Synthetic oligonucleotide

SEQ ID NO: 418158 - DNA, 32 bp, Artificial Sequence; identical to SEQ ID NO: 70788
  Description of Artificial Sequence: Synthetic oligonucleotide

SEQ ID NO: 418159 - DNA, 32 bp, Artificial Sequence; identical to SEQ ID NO: 70789
  Description of Artificial Sequence: Synthetic oligonucleotide

SEQ ID NO: 418160 - DNA, 31 bp, Artificial Sequence; identical to SEQ ID NO: 70790
  Description of Artificial Sequence: Synthetic oligonucleotide

SEQ ID NO: 418161 - DNA, 30 bp, Artificial Sequence; identical to SEQ ID NO: 70791
  Description of Artificial Sequence: Synthetic oligonucleotide

SEQ ID NO: 418162 - DNA, 31 bp, Artificial Sequence; identical to SEQ ID NO: 70792
  Description of Artificial Sequence: Synthetic oligonucleotide

SEQ ID NO: 418163 - DNA, 31 bp, Artificial Sequence; identical to SEQ ID NO: 70793
  Description of Artificial Sequence: Synthetic oligonucleotide

SEQ ID NO: 418164 - DNA, 30 bp, Artificial Sequence; identical to SEQ ID NO: 70794
  Description of Artificial Sequence: Synthetic oligonucleotide

SEQ ID NO: 418165 - DNA, 30 bp, Artificial Sequence; identical to SEQ ID NO: 70795
  Description of Artificial Sequence: Synthetic oligonucleotide

SEQ ID NO: 418166 - DNA, 29 bp, Artificial Sequence
  Description of Artificial Sequence: Synthetic oligonucleotide
gagtgtcatttcttcagtgggacggagcg

SEQ ID NO: 418167 - DNA, 29 bp, Artificial Sequence
  Description of Artificial Sequence: Synthetic oligonucleotide
agtgtcatttcttcagtgggacggagcgg

SEQ ID NO: 418168 - DNA, 28 bp, Artificial Sequence
  Description of Artificial Sequence: Synthetic oligonucleotide
gtgtcatttcttcagtgggacggagcgg

SEQ ID NO: 418169 - DNA, 28 bp, Artificial Sequence
  Description of Artificial Sequence: Synthetic oligonucleotide
tgtcatttcttcagtgggacggagcggg

SEQ ID NO: 418170 - DNA, 27 bp, Artificial Sequence
  Description of Artificial Sequence: Synthetic oligonucleotide
gtcatttcttcagtgggacggagcggg

SEQ ID NO: 418171 - DNA, 28 bp, Artificial Sequence
  Description of Artificial Sequence: Synthetic oligonucleotide
tcatttcttcagtgggacggagcgggtg

SEQ ID NO: 418172 - DNA, 27 bp, Artificial Sequence
  Description of Artificial Sequence: Synthetic oligonucleotide
catttcttcagtgggacggagcgggtg

SEQ ID NO: 418173 - DNA, 27 bp, Artificial Sequence
  Description of Artificial Sequence: Synthetic oligonucleotide
atttcttcagtgggacggagcgggtgc

SEQ ID NO: 418174 - DNA, 26 bp, Artificial Sequence
  Description of Artificial Sequence: Synthetic oligonucleotide
tttcttcagtgggacggagcgggtgc

SEQ ID NO: 418175 - DNA, 25 bp, Artificial Sequence
  Description of Artificial Sequence: Synthetic oligonucleotide
ttcttcagtgggacggagcgggtgc

SEQ ID NO: 418176 - DNA, 24 bp, Artificial Sequence
  Description of Artificial Sequence: Synthetic oligonucleotide
tcttcagtgggacggagcgggtgc

SEQ ID NO: 418177 - DNA, 23 bp, Artificial Sequence
  Description of Artificial Sequence: Synthetic oligonucleotide
cttcagtgggacggagcgggtgc

SEQ ID NO: 418178 - DNA, 23 bp, Artificial Sequence
  Description of Artificial Sequence: Synthetic oligonucleotide
ttcagtgggacggagcgggtgcg

SEQ ID NO: 418179 - DNA, 22 bp, Artificial Sequence
  Description of Artificial Sequence: Synthetic oligonucleotide
tcagtgggacggagcgggtgcg

SEQ ID NO: 418180 - DNA, 21 bp, Artificial Sequence
  Description of Artificial Sequence: Synthetic oligonucleotide
cagtgggacggagcgggtgcg

SEQ ID NO: 418181 - DNA, 23 bp, Artificial Sequence
  Description of Artificial Sequence: Synthetic oligonucleotide
agtgggacggagcgggtgcggtt

SEQ ID NO: 418182 - DNA, 22 bp, Artificial Sequence
  Description of Artificial Sequence: Synthetic oligonucleotide
gtgggacggagcgggtgcggtt

SEQ ID NO: 418183 - DNA, 33 bp, Artificial Sequence; identical to SEQ ID NO: 70813
  Description of Artificial Sequence: Synthetic oligonucleotide

SEQ ID NO: 418184 - DNA, 32 bp, Artificial Sequence; identical to SEQ ID NO: 70814
  Description of Artificial Sequence: Synthetic oligonucleotide

SEQ ID NO: 418185 - DNA, 33 bp, Artificial Sequence; identical to SEQ ID NO: 70815
  Description of Artificial Sequence: Synthetic oligonucleotide

SEQ ID NO: 418186 - DNA, 33 bp, Artificial Sequence; identical to SEQ ID NO: 70816
  Description of Artificial Sequence: Synthetic oligonucleotide

SEQ ID NO: 418187 - DNA, 34 bp, Artificial Sequence; identical to SEQ ID NO: 70817
  Description of Artificial Sequence: Synthetic oligonucleotide

SEQ ID NO: 418188 - DNA, 36 bp, Artificial Sequence; identical to SEQ ID NO: 70818
  Description of Artificial Sequence: Synthetic oligonucleotide

SEQ ID NO: 418189 - DNA, 35 bp, Artificial Sequence; identical to SEQ ID NO: 70819
  Description of Artificial Sequence: Synthetic oligonucleotide

SEQ ID NO: 418190 - DNA, 27 bp, Artificial Sequence
  Description of Artificial Sequence: Synthetic oligonucleotide
ccgcggtggacacctactgcagacaaa

SEQ ID NO: 418191 - DNA, 28 bp, Artificial Sequence
  Description of Artificial Sequence: Synthetic oligonucleotide
cgcggtggacacctactgcagacaaaac

SEQ ID NO: 418192 - DNA, 30 bp, Artificial Sequence; identical to SEQ ID NO: 70822
  Description of Artificial Sequence: Synthetic oligonucleotide

SEQ ID NO: 418193 - DNA, 30 bp, Artificial Sequence; identical to SEQ ID NO: 70823
  Description of Artificial Sequence: Synthetic oligonucleotide

SEQ ID NO: 418194 - DNA, 30 bp, Artificial Sequence; identical to SEQ ID NO: 70824
  Description of Artificial Sequence: Synthetic oligonucleotide

SEQ ID NO: 418195 - DNA, 30 bp, Artificial Sequence; identical to SEQ ID NO: 70825
  Description of Artificial Sequence: Synthetic oligonucleotide

SEQ ID NO: 418196 - DNA, 30 bp, Artificial Sequence; identical to SEQ ID NO: 70826
  Description of Artificial Sequence: Synthetic oligonucleotide

SEQ ID NO: 418197 - DNA, 29 bp, Artificial Sequence
  Description of Artificial Sequence: Synthetic oligonucleotide
ggacacctactgcagacaaaactacgggg

SEQ ID NO: 418198 - DNA, 31 bp, Artificial Sequence; identical to SEQ ID NO: 70828
  Description of Artificial Sequence: Synthetic oligonucleotide

SEQ ID NO: 418199 - DNA, 31 bp, Artificial Sequence; identical to SEQ ID NO: 70829
  Description of Artificial Sequence: Synthetic oligonucleotide

SEQ ID NO: 418200 - DNA, 30 bp, Artificial Sequence; identical to SEQ ID NO: 70830
  Description of Artificial Sequence: Synthetic oligonucleotide

SEQ ID NO: 418201 - DNA, 31 bp, Artificial Sequence; identical to SEQ ID NO: 70831
  Description of Artificial Sequence: Synthetic oligonucleotide

SEQ ID NO: 418202 - DNA, 30 bp, Artificial Sequence; identical to SEQ ID NO: 70832
  Description of Artificial Sequence: Synthetic oligonucleotide

SEQ ID NO: 418203 - DNA, 31 bp, Artificial Sequence; identical to SEQ ID NO: 70833
  Description of Artificial Sequence: Synthetic oligonucleotide

SEQ ID NO: 418204 - DNA, 32 bp, Artificial Sequence; identical to SEQ ID NO: 70834
  Description of Artificial Sequence: Synthetic oligonucleotide

SEQ ID NO: 418205 - DNA, 31 bp, Artificial Sequence; identical to SEQ ID NO: 70835
  Description of Artificial Sequence: Synthetic oligonucleotide

SEQ ID NO: 418206 - DNA, 30 bp, Artificial Sequence; identical to SEQ ID NO: 70836
  Description of Artificial Sequence: Synthetic oligonucleotide

SEQ ID NO: 418207 - DNA, 30 bp, Artificial Sequence; identical to SEQ ID NO: 70837
  Description of Artificial Sequence: Synthetic oligonucleotide

SEQ ID NO: 418208 - DNA, 29 bp, Artificial Sequence
  Description of Artificial Sequence: Synthetic oligonucleotide
gcagacaaaactacggggttggtgagagc

SEQ ID NO: 418209 - DNA, 31 bp, Artificial Sequence; identical to SEQ ID NO: 70839
  Description of Artificial Sequence: Synthetic oligonucleotide

SEQ ID NO: 418210 - DNA, 32 bp, Artificial Sequence; identical to SEQ ID NO: 70840
  Description of Artificial Sequence: Synthetic oligonucleotide

SEQ ID NO: 418211 - DNA, 31 bp, Artificial Sequence; identical to SEQ ID NO: 70841
  Description of Artificial Sequence: Synthetic oligonucleotide

SEQ ID NO: 418212 - DNA, 32 bp, Artificial Sequence; identical to SEQ ID NO: 70842
  Description of Artificial Sequence: Synthetic oligonucleotide

SEQ ID NO: 418213 - DNA, 31 bp, Artificial Sequence; identical to SEQ ID NO: 70843
  Description of Artificial Sequence: Synthetic oligonucleotide

SEQ ID NO: 418214 - DNA, 32 bp, Artificial Sequence; identical to SEQ ID NO: 70844
  Description of Artificial Sequence: Synthetic oligonucleotide

SEQ ID NO: 418215 - DNA, 31 bp, Artificial Sequence; identical to SEQ ID NO: 70845
  Description of Artificial Sequence: Synthetic oligonucleotide

SEQ ID NO: 418216 - DNA, 31 bp, Artificial Sequence; identical to SEQ ID NO: 70846
  Description of Artificial Sequence: Synthetic oligonucleotide

SEQ ID NO: 418217 - DNA, 30 bp, Artificial Sequence; identical to SEQ ID NO: 70847
  Description of Artificial Sequence: Synthetic oligonucleotide

SEQ ID NO: 418218 - DNA, 31 bp, Artificial Sequence; identical to SEQ ID NO: 70848
  Description of Artificial Sequence: Synthetic oligonucleotide

SEQ ID NO: 418219 - DNA, 32 bp, Artificial Sequence; identical to SEQ ID NO: 70849
  Description of Artificial Sequence: Synthetic oligonucleotide

SEQ ID NO: 418220 - DNA, 31 bp, Artificial Sequence; identical to SEQ ID NO: 70850
  Description of Artificial Sequence: Synthetic oligonucleotide

SEQ ID NO: 418221 - DNA, 30 bp, Artificial Sequence; identical to SEQ ID NO: 70851
  Description of Artificial Sequence: Synthetic oligonucleotide

SEQ ID NO: 418222 - DNA, 32 bp, Artificial Sequence; identical to SEQ ID NO: 70875
  Description of Artificial Sequence: Synthetic oligonucleotide

SEQ ID NO: 418223 - DNA, 31 bp, Artificial Sequence; identical to SEQ ID NO: 70876
  Description of Artificial Sequence: Synthetic oligonucleotide

SEQ ID NO: 418224 - DNA, 31 bp, Artificial Sequence; identical to SEQ ID NO: 70877
  Description of Artificial Sequence: Synthetic oligonucleotide

SEQ ID NO: 418225 - DNA, 30 bp, Artificial Sequence; identical to SEQ ID NO: 70878
  Description of Artificial Sequence: Synthetic oligonucleotide

SEQ ID NO: 418226 - DNA, 30 bp, Artificial Sequence; identical to SEQ ID NO: 70879
  Description of Artificial Sequence: Synthetic oligonucleotide

SEQ ID NO: 418227 - DNA, 29 bp, Artificial Sequence
  Description of Artificial Sequence: Synthetic oligonucleotide
catttcttcaatgggacggagcggatgcg

SEQ ID NO: 418228 - DNA, 29 bp, Artificial Sequence
  Description of Artificial Sequence: Synthetic oligonucleotide
atttcttcaatgggacggagcggatgcgg

SEQ ID NO: 418229 - DNA, 28 bp, Artificial Sequence
  Description of Artificial Sequence: Synthetic oligonucleotide
tttcttcaatgggacggagcggatgcgg

SEQ ID NO: 418230 - DNA, 27 bp, Artificial Sequence
  Description of Artificial Sequence: Synthetic oligonucleotide
ttcttcaatgggacggagcggatgcgg

SEQ ID NO: 418231 - DNA, 27 bp, Artificial Sequence
  Description of Artificial Sequence: Synthetic oligonucleotide
tcttcaatgggacggagcggatgcggt

SEQ ID NO: 418232 - DNA, 27 bp, Artificial Sequence
  Description of Artificial Sequence: Synthetic oligonucleotide
cttcaatgggacggagcggatgcggtt

SEQ ID NO: 418233 - DNA, 27 bp, Artificial Sequence
  Description of Artificial Sequence: Synthetic oligonucleotide
ttcaatgggacggagcggatgcggttc

SEQ ID NO: 418234 - DNA, 26 bp, Artificial Sequence
  Description of Artificial Sequence: Synthetic oligonucleotide
tcaatgggacggagcggatgcggttc

SEQ ID NO: 418235 - DNA, 25 bp, Artificial Sequence
  Description of Artificial Sequence: Synthetic oligonucleotide
caatgggacggagcggatgcggttc

SEQ ID NO: 418236 - DNA, 26 bp, Artificial Sequence
  Description of Artificial Sequence: Synthetic oligonucleotide
aatgggacggagcggatgcggttcct

SEQ ID NO: 418237 - DNA, 25 bp, Artificial Sequence
  Description of Artificial Sequence: Synthetic oligonucleotide
atgggacggagcggatgcggttcct

SEQ ID NO: 418238 - DNA, 24 bp, Artificial Sequence
  Description of Artificial Sequence: Synthetic oligonucleotide
tgggacggagcggatgcggttcct

SEQ ID NO: 418239 - DNA, 23 bp, Artificial Sequence
  Description of Artificial Sequence: Synthetic oligonucleotide
gggacggagcggatgcggttcct

SEQ ID NO: 418240 - DNA, 23 bp, Artificial Sequence
  Description of Artificial Sequence: Synthetic oligonucleotide
ggacggagcggatgcggttcctg

SEQ ID NO: 418241 - DNA, 24 bp, Artificial Sequence
  Description of Artificial Sequence: Synthetic oligonucleotide
gacggagcggatgcggttcctgga

SEQ ID NO: 418242 - DNA, 25 bp, Artificial Sequence
  Description of Artificial Sequence: Synthetic oligonucleotide
acggagcggatgcggttcctggaca

SEQ ID NO: 418243 - DNA, 24 bp, Artificial Sequence
  Description of Artificial Sequence: Synthetic oligonucleotide
cggagcggatgcggttcctggaca

SEQ ID NO: 418244 - DNA, 27 bp, Artificial Sequence
  Description of Artificial Sequence: Synthetic oligonucleotide
ggagcggatgcggttcctggacagata

SEQ ID NO: 418245 - DNA, 27 bp, Artificial Sequence
  Description of Artificial Sequence: Synthetic oligonucleotide
gagcggatgcggttcctggacagatac

SEQ ID NO: 418246 - DNA, 29 bp, Artificial Sequence
  Description of Artificial Sequence: Synthetic oligonucleotide
agcggatgcggttcctggacagatacttc

SEQ ID NO: 418247 - DNA, 28 bp, Artificial Sequence
  Description of Artificial Sequence: Synthetic oligonucleotide
gcggatgcggttcctggacagatacttc

SEQ ID NO: 418248 - DNA, 33 bp, Artificial Sequence; identical to SEQ ID NO: 70901
  Description of Artificial Sequence: Synthetic oligonucleotide

SEQ ID NO: 418249 - DNA, 33 bp, Artificial Sequence; identical to SEQ ID NO: 70902
  Description of Artificial Sequence: Synthetic oligonucleotide

SEQ ID NO: 418250 - DNA, 35 bp, Artificial Sequence; identical to SEQ ID NO: 70903
  Description of Artificial Sequence: Synthetic oligonucleotide

SEQ ID NO: 418251 - DNA, 36 bp, Artificial Sequence; identical to SEQ ID NO: 70904
  Description of Artificial Sequence: Synthetic oligonucleotide

SEQ ID NO: 418252 - DNA, 31 bp, Artificial Sequence; identical to SEQ ID NO: 70905
  Description of Artificial Sequence: Synthetic oligonucleotide

SEQ ID NO: 418253 - DNA, 31 bp, Artificial Sequence; identical to SEQ ID NO: 70906
  Description of Artificial Sequence: Synthetic oligonucleotide

SEQ ID NO: 418254 - DNA, 30 bp, Artificial Sequence; identical to SEQ ID NO: 70907
  Description of Artificial Sequence: Synthetic oligonucleotide

SEQ ID NO: 418255 - DNA, 31 bp, Artificial Sequence; identical to SEQ ID NO: 70908
  Description of Artificial Sequence: Synthetic oligonucleotide

SEQ ID NO: 418256 - DNA, 30 bp, Artificial Sequence; identical to SEQ ID NO: 70909
  Description of Artificial Sequence: Synthetic oligonucleotide

SEQ ID NO: 418257 - DNA, 31 bp, Artificial Sequence; identical to SEQ ID NO: 70910
  Description of Artificial Sequence: Synthetic oligonucleotide

SEQ ID NO: 418258 - DNA, 32 bp, Artificial Sequence; identical to SEQ ID NO: 70911
  Description of Artificial Sequence: Synthetic oligonucleotide

SEQ ID NO: 418259 - DNA, 31 bp, Artificial Sequence; identical to SEQ ID NO: 70912
  Description of Artificial Sequence: Synthetic oligonucleotide

SEQ ID NO: 418260 - DNA, 30 bp, Artificial Sequence; identical to SEQ ID NO: 70913
  Description of Artificial Sequence: Synthetic oligonucleotide

SEQ ID NO: 418261 - DNA, 30 bp, Artificial Sequence; identical to SEQ ID NO: 70914
  Description of Artificial Sequence: Synthetic oligonucleotide

SEQ ID NO: 418262 - DNA, 29 bp, Artificial Sequence
  Description of Artificial Sequence: Synthetic oligonucleotide
gcagacacaactacgggattggtgagagc

SEQ ID NO: 418263 - DNA, 31 bp, Artificial Sequence; identical to SEQ ID NO: 70916
  Description of Artificial Sequence: Synthetic oligonucleotide

SEQ ID NO: 418264 - DNA, 32 bp, Artificial Sequence; identical to SEQ ID NO: 70917
  Description of Artificial Sequence: Synthetic oligonucleotide

SEQ ID NO: 418265 - DNA, 31 bp, Artificial Sequence; identical to SEQ ID NO: 70918
  Description of Artificial Sequence: Synthetic oligonucleotide

SEQ ID NO: 418266 - DNA, 32 bp, Artificial Sequence; identical to SEQ ID NO: 70919
  Description of Artificial Sequence: Synthetic oligonucleotide

SEQ ID NO: 418267 - DNA, 31 bp, Artificial Sequence; identical to SEQ ID NO: 70920
  Description of Artificial Sequence: Synthetic oligonucleotide

SEQ ID NO: 418268 - DNA, 32 bp, Artificial Sequence; identical to SEQ ID NO: 70921
  Description of Artificial Sequence: Synthetic oligonucleotide

SEQ ID NO: 418269 - DNA, 31 bp, Artificial Sequence; identical to SEQ ID NO: 70922
  Description of Artificial Sequence: Synthetic oligonucleotide

SEQ ID NO: 418270 - DNA, 31 bp, Artificial Sequence; identical to SEQ ID NO: 70923
  Description of Artificial Sequence: Synthetic oligonucleotide

SEQ ID NO: 418271 - DNA, 30 bp, Artificial Sequence; identical to SEQ ID NO: 70924
  Description of Artificial Sequence: Synthetic oligonucleotide

SEQ ID NO: 418272 - DNA, 29 bp, Artificial Sequence
  Description of Artificial Sequence: Synthetic oligonucleotide
ctacgggattggtgagagcttcacagtgc

SEQ ID NO: 418273 - DNA, 30 bp, Artificial Sequence; identical to SEQ ID NO: 70926
  Description of Artificial Sequence: Synthetic oligonucleotide

SEQ ID NO: 418274 - DNA, 29 bp, Artificial Sequence
  Description of Artificial Sequence: Synthetic oligonucleotide
acgggattggtgagagcttcacagtgcag

SEQ ID NO: 418275 - DNA, 28 bp, Artificial Sequence
  Description of Artificial Sequence: Synthetic oligonucleotide
cgggattggtgagagcttcacagtgcag

SEQ ID NO: 418276 - DNA, 28 bp, Artificial Sequence
  Description of Artificial Sequence: Synthetic oligonucleotide
gggattggtgagagcttcacagtgcagc

SEQ ID NO: 418277 - DNA, 28 bp, Artificial Sequence
  Description of Artificial Sequence: Synthetic oligonucleotide
ggattggtgagagcttcacagtgcagcg

SEQ ID NO: 418278 - DNA, 28 bp, Artificial Sequence
  Description of Artificial Sequence: Synthetic oligonucleotide
gattggtgagagcttcacagtgcagcgg

SEQ ID NO: 418279 - DNA, 28 bp, Artificial Sequence
  Description of Artificial Sequence: Synthetic oligonucleotide
attggtgagagcttcacagtgcagcggc

SEQ ID NO: 418280 - DNA, 31 bp, Artificial Sequence; identical to SEQ ID NO: 70933
  Description of Artificial Sequence: Synthetic oligonucleotide

SEQ ID NO: 418281 - DNA, 31 bp, Artificial Sequence; identical to SEQ ID NO: 70934
  Description of Artificial Sequence: Synthetic oligonucleotide

SEQ ID NO: 418282 - DNA, 30 bp, Artificial Sequence; identical to SEQ ID NO: 70935
  Description of Artificial Sequence: Synthetic oligonucleotide

SEQ ID NO: 418283 - DNA, 29 bp, Artificial Sequence
  Description of Artificial Sequence: Synthetic oligonucleotide
cagccagaaggacttcctggaagacaagc

SEQ ID NO: 418284 - DNA, 29 bp, Artificial Sequence
  Description of Artificial Sequence: Synthetic oligonucleotide
agccagaaggacttcctggaagacaagcg

SEQ ID NO: 418285 - DNA, 28 bp, Artificial Sequence
  Description of Artificial Sequence: Synthetic oligonucleotide
gccagaaggacttcctggaagacaagcg

SEQ ID NO: 418286 - DNA, 28 bp, Artificial Sequence
  Description of Artificial Sequence: Synthetic oligonucleotide
ccagaaggacttcctggaagacaagcgg

SEQ ID NO: 418287 - DNA, 28 bp, Artificial Sequence
  Description of Artificial Sequence: Synthetic oligonucleotide
cagaaggacttcctggaagacaagcggg

SEQ ID NO: 418288 - DNA, 28 bp, Artificial Sequence
  Description of Artificial Sequence: Synthetic oligonucleotide
agaaggacttcctggaagacaagcgggc

SEQ ID NO: 418289 - DNA, 27 bp, Artificial Sequence
  Description of Artificial Sequence: Synthetic oligonucleotide
gaaggacttcctggaagacaagcgggc

SEQ ID NO: 418290 - DNA, 27 bp, Artificial Sequence
  Description of Artificial Sequence: Synthetic oligonucleotide
aaggacttcctggaagacaagcgggcc

SEQ ID NO: 418291 - DNA, 26 bp, Artificial Sequence
  Description of Artificial Sequence: Synthetic oligonucleotide
aggacttcctggaagacaagcgggcc

SEQ ID NO: 418292 - DNA, 25 bp, Artificial Sequence
  Description of Artificial Sequence: Synthetic oligonucleotide
ggacttcctggaagacaagcgggcc

SEQ ID NO: 418293 - DNA, 25 bp, Artificial Sequence
  Description of Artificial Sequence: Synthetic oligonucleotide
gacttcctggaagacaagcgggccg

SEQ ID NO: 418294 - DNA, 25 bp, Artificial Sequence
  Description of Artificial Sequence: Synthetic oligonucleotide
acttcctggaagacaagcgggccgc

SEQ ID NO: 418295 - DNA, 24 bp, Artificial Sequence
  Description of Artificial Sequence: Synthetic oligonucleotide
cttcctggaagacaagcgggccgc

SEQ ID NO: 418296 - DNA, 24 bp, Artificial Sequence
  Description of Artificial Sequence: Synthetic oligonucleotide
ttcctggaagacaagcgggccgcg

SEQ ID NO: 418297 - DNA, 21 bp, Artificial Sequence
  Description of Artificial Sequence: Synthetic oligonucleotide
ggcggtgacggagctggggca

SEQ ID NO: 418298 - DNA, 21 bp, Artificial Sequence
  Description of Artificial Sequence: Synthetic oligonucleotide
gcggtgacggagctggggcag

SEQ ID NO: 418299 - DNA, 21 bp, Artificial Sequence
  Description of Artificial Sequence: Synthetic oligonucleotide
cggtgacggagctggggcagc

SEQ ID NO: 418300 - DNA, 22 bp, Artificial Sequence
  Description of Artificial Sequence: Synthetic oligonucleotide
ggtgacggagctggggcagcct

SEQ ID NO: 418301 - DNA, 24 bp, Artificial Sequence
  Description of Artificial Sequence: Synthetic oligonucleotide
gtgacggagctggggcagcctgat

SEQ ID NO: 418302 - DNA, 25 bp, Artificial Sequence
  Description of Artificial Sequence: Synthetic oligonucleotide
tgacggagctggggcagcctgatga

SEQ ID NO: 418303 - DNA, 24 bp, Artificial Sequence
  Description of Artificial Sequence: Synthetic oligonucleotide
gacggagctggggcagcctgatga

SEQ ID NO: 418304 - DNA, 24 bp, Artificial Sequence
  Description of Artificial Sequence: Synthetic oligonucleotide
acggagctggggcagcctgatgag

SEQ ID NO: 418305 - DNA, 23 bp, Artificial Sequence
  Description of Artificial Sequence: Synthetic oligonucleotide
cggagctggggcagcctgatgag

SEQ ID NO: 418306 - DNA, 24 bp, Artificial Sequence
  Description of Artificial Sequence: Synthetic oligonucleotide
ggagctggggcagcctgatgagga

SEQ ID NO: 418307 - DNA, 26 bp, Artificial Sequence
  Description of Artificial Sequence: Synthetic oligonucleotide
gagctggggcagcctgatgaggagta

SEQ ID NO: 418308 - DNA, 27 bp, Artificial Sequence
  Description of Artificial Sequence: Synthetic oligonucleotide
agctggggcagcctgatgaggagtact

SEQ ID NO: 418309 - DNA, 26 bp, Artificial Sequence
  Description of Artificial Sequence: Synthetic oligonucleotide
gctggggcagcctgatgaggagtact

SEQ ID NO: 418310 - DNA, 26 bp, Artificial Sequence
  Description of Artificial Sequence: Synthetic oligonucleotide
ctggggcagcctgatgaggagtactg

SEQ ID NO: 418311 - DNA, 27 bp, Artificial Sequence
  Description of Artificial Sequence: Synthetic oligonucleotide
tggggcagcctgatgaggagtactgga

SEQ ID NO: 418312 - DNA, 27 bp, Artificial Sequence
  Description of Artificial Sequence: Synthetic oligonucleotide
ggggcagcctgatgaggagtactggaa

SEQ ID NO: 418313 - DNA, 27 bp, Artificial Sequence
  Description of Artificial Sequence: Synthetic oligonucleotide
gggcagcctgatgaggagtactggaac

SEQ ID NO: 418314 - DNA, 28 bp, Artificial Sequence
  Description of Artificial Sequence: Synthetic oligonucleotide
ggcagcctgatgaggagtactggaacag

SEQ ID NO: 418315 - DNA, 28 bp, Artificial Sequence
  Description of Artificial Sequence: Synthetic oligonucleotide
gcagcctgatgaggagtactggaacagc

SEQ ID NO: 418316 - DNA, 28 bp, Artificial Sequence
  Description of Artificial Sequence: Synthetic oligonucleotide
cagcctgatgaggagtactggaacagcc

SEQ ID NO: 418317 - DNA, 29 bp, Artificial Sequence
  Description of Artificial Sequence: Synthetic oligonucleotide
agcctgatgaggagtactggaacagccag

SEQ ID NO: 418318 - DNA, 31 bp, Artificial Sequence; identical to SEQ ID NO: 70971
  Description of Artificial Sequence: Synthetic oligonucleotide

SEQ ID NO: 418319 - DNA, 32 bp, Artificial Sequence; identical to SEQ ID NO: 70972
  Description of Artificial Sequence: Synthetic oligonucleotide

SEQ ID NO: 418320 - DNA, 31 bp, Artificial Sequence; identical to SEQ ID NO: 70973
  Description of Artificial Sequence: Synthetic oligonucleotide

SEQ ID NO: 418321 - DNA, 35 bp, Artificial Sequence; identical to SEQ ID NO: 70974
  Description of Artificial Sequence: Synthetic oligonucleotide

SEQ ID NO: 418322 - DNA, 37 bp, Artificial Sequence; identical to SEQ ID NO: 70975
  Description of Artificial Sequence: Synthetic oligonucleotide

SEQ ID NO: 418323 - DNA, 36 bp, Artificial Sequence; identical to SEQ ID NO: 70976
  Description of Artificial Sequence: Synthetic oligonucleotide

SEQ ID NO: 418324 - DNA, 35 bp, Artificial Sequence; identical to SEQ ID NO: 70977
  Description of Artificial Sequence: Synthetic oligonucleotide

SEQ ID NO: 418325 - DNA, 34 bp, Artificial Sequence; identical to SEQ ID NO: 70978
  Description of Artificial Sequence: Synthetic oligonucleotide

SEQ ID NO: 418326 - DNA, 37 bp, Artificial Sequence; identical to SEQ ID NO: 70979
  Description of Artificial Sequence: Synthetic oligonucleotide

SEQ ID NO: 418327 - DNA, 36 bp, Artificial Sequence; identical to SEQ ID NO: 70980
  Description of Artificial Sequence: Synthetic oligonucleotide

SEQ ID NO: 418328 - DNA, 35 bp, Artificial Sequence; identical to SEQ ID NO: 70981
  Description of Artificial Sequence: Synthetic oligonucleotide

SEQ ID NO: 418329 - DNA, 35 bp, Artificial Sequence; identical to SEQ ID NO: 70982
  Description of Artificial Sequence: Synthetic oligonucleotide

SEQ ID NO: 418330 - DNA, 35 bp, Artificial Sequence; identical to SEQ ID NO: 70983
  Description of Artificial Sequence: Synthetic oligonucleotide

SEQ ID NO: 418331 - DNA, 34 bp, Artificial Sequence; identical to SEQ ID NO: 70984
  Description of Artificial Sequence: Synthetic oligonucleotide

SEQ ID NO: 418332 - DNA, 35 bp, Artificial Sequence; identical to SEQ ID NO: 70985
  Description of Artificial Sequence: Synthetic oligonucleotide

SEQ ID NO: 418333 - DNA, 34 bp, Artificial Sequence; identical to SEQ ID NO: 70986
  Description of Artificial Sequence: Synthetic oligonucleotide

SEQ ID NO: 418334 - DNA, 29 bp, Artificial Sequence
  Description of Artificial Sequence: Synthetic oligonucleotide
aggagcactggaacagccagaaggacttc

SEQ ID NO: 418335 - DNA, 28 bp, Artificial Sequence
  Description of Artificial Sequence: Synthetic oligonucleotide
acagtgcagcggcgagtccatcctaatg

SEQ ID NO: 418336 - DNA, 27 bp, Artificial Sequence
  Description of Artificial Sequence: Synthetic oligonucleotide
cagtgcagcggcgagtccatcctaatg

SEQ ID NO: 418337 - DNA, 28 bp, Artificial Sequence
  Description of Artificial Sequence: Synthetic oligonucleotide
agtgcagcggcgagtccatcctaatgtg

SEQ ID NO: 418338 - DNA, 27 bp, Artificial Sequence
  Description of Artificial Sequence: Synthetic oligonucleotide
gtgcagcggcgagtccatcctaatgtg

SEQ ID NO: 418339 - DNA, 28 bp, Artificial Sequence
  Description of Artificial Sequence: Synthetic oligonucleotide
tgcagcggcgagtccatcctaatgtgac

SEQ ID NO: 418340 - DNA, 27 bp, Artificial Sequence
  Description of Artificial Sequence: Synthetic oligonucleotide
gcagcggcgagtccatcctaatgtgac

SEQ ID NO: 418341 - DNA, 28 bp, Artificial Sequence
  Description of Artificial Sequence: Synthetic oligonucleotide
cagcggcgagtccatcctaatgtgactg

SEQ ID NO: 418342 - DNA, 29 bp, Artificial Sequence
  Description of Artificial Sequence: Synthetic oligonucleotide
agcggcgagtccatcctaatgtgactgtg

SEQ ID NO: 418343 - DNA, 28 bp, Artificial Sequence
  Description of Artificial Sequence: Synthetic oligonucleotide
gcggcgagtccatcctaatgtgactgtg

SEQ ID NO: 418344 - DNA, 31 bp, Artificial Sequence
  Description of Artificial Sequence: Synthetic oligonucleotide
cggcgagtccatcctaatgtgactgtgtatc

SEQ ID NO: 418345 - DNA, 31 bp, Artificial Sequence
  Description of Artificial Sequence: Synthetic oligonucleotide
ggcgagtccatcctaatgtgactgtgtatcc

SEQ ID NO: 418346 - DNA, 33 bp, Artificial Sequence
  Description of Artificial Sequence: Synthetic oligonucleotide
gcgagtccatcctaatgtgactgtgtatccttc

SEQ ID NO: 418347 - DNA, 36 bp, Artificial Sequence
  Description of Artificial Sequence: Synthetic oligonucleotide
cgagtccatcctaatgtgactgtgtatccttcaaag

SEQ ID NO: 418348 - DNA, 37 bp, Artificial Sequence
  Description of Artificial Sequence: Synthetic oligonucleotide
gagtccatcctaatgtgactgtgtatccttcaaagac

SEQ ID NO: 418349 - DNA, 37 bp, Artificial Sequence
  Description of Artificial Sequence: Synthetic oligonucleotide
agtccatcctaatgtgactgtgtatccttcaaagacc

SEQ ID NO: 418350 - DNA, 36 bp, Artificial Sequence
  Description of Artificial Sequence: Synthetic oligonucleotide
gtccatcctaatgtgactgtgtatccttcaaagacc

SEQ ID NO: 418351 - DNA, 36 bp, Artificial Sequence
  Description of Artificial Sequence: Synthetic oligonucleotide
tccatcctaatgtgactgtgtatccttcaaagaccc

SEQ ID NO: 418352 - DNA, 35 bp, Artificial Sequence
  Description of Artificial Sequence: Synthetic oligonucleotide
ccatcctaatgtgactgtgtatccttcaaagaccc

SEQ ID NO: 418353 - DNA, 36 bp, Artificial Sequence
  Description of Artificial Sequence: Synthetic oligonucleotide
catcctaatgtgactgtgtatccttcaaagacccag

SEQ ID NO: 418354 - DNA, 36 bp, Artificial Sequence
  Description of Artificial Sequence: Synthetic oligonucleotide
atcctaatgtgactgtgtatccttcaaagacccagc

SEQ ID NO: 418355 - DNA, 35 bp, Artificial Sequence
  Description of Artificial Sequence: Synthetic oligonucleotide
tcctaatgtgactgtgtatccttcaaagacccagc

SEQ ID NO: 418356 - DNA, 34 bp, Artificial Sequence
  Description of Artificial Sequence: Synthetic oligonucleotide
cctaatgtgactgtgtatccttcaaagacccagc

SEQ ID NO: 418357 - DNA, 34 bp, Artificial Sequence
  Description of Artificial Sequence: Synthetic oligonucleotide
ctaatgtgactgtgtatccttcaaagacccagcc

SEQ ID NO: 418358 - DNA, 34 bp, Artificial Sequence
  Description of Artificial Sequence: Synthetic oligonucleotide
taatgtgactgtgtatccttcaaagacccagccc

SEQ ID NO: 418359 - DNA, 33 bp, Artificial Sequence
  Description of Artificial Sequence: Synthetic oligonucleotide
aatgtgactgtgtatccttcaaagacccagccc

SEQ ID NO: 418360 - DNA, 32 bp, Artificial Sequence
  Description of Artificial Sequence: Synthetic oligonucleotide
atgtgactgtgtatccttcaaagacccagccc

SEQ ID NO: 418361 - DNA, 31 bp, Artificial Sequence
  Description of Artificial Sequence: Synthetic oligonucleotide
tgtgactgtgtatccttcaaagacccagccc

SEQ ID NO: 418362 - DNA, 29 bp, Artificial Sequence
  Description of Artificial Sequence: Synthetic oligonucleotide
aacagccagaaggacatcctggaagacgg

SEQ ID NO: 418363 - DNA, 28 bp, Artificial Sequence
  Description of Artificial Sequence: Synthetic oligonucleotide
acagccagaaggacatcctggaagacgg

SEQ ID NO: 418364 - DNA, 27 bp, Artificial Sequence
  Description of Artificial Sequence: Synthetic oligonucleotide
cagccagaaggacatcctggaagacgg

SEQ ID NO: 418365 - DNA, 27 bp, Artificial Sequence
  Description of Artificial Sequence: Synthetic oligonucleotide
agccagaaggacatcctggaagacggg

SEQ ID NO: 418366 - DNA, 26 bp, Artificial Sequence
  Description of Artificial Sequence: Synthetic oligonucleotide
gccagaaggacatcctggaagacggg

SEQ ID NO: 418367 - DNA, 26 bp, Artificial Sequence
  Description of Artificial Sequence: Synthetic oligonucleotide
ccagaaggacatcctggaagacgggc

SEQ ID NO: 418368 - DNA, 26 bp, Artificial Sequence
  Description of Artificial Sequence: Synthetic oligonucleotide
cagaaggacatcctggaagacgggcg

SEQ ID NO: 418369 - DNA, 26 bp, Artificial Sequence
  Description of Artificial Sequence: Synthetic oligonucleotide
agaaggacatcctggaagacgggcgg

SEQ ID NO: 418370 - DNA, 25 bp, Artificial Sequence
  Description of Artificial Sequence: Synthetic oligonucleotide
gaaggacatcctggaagacgggcgg

SEQ ID NO: 418371 - DNA, 25 bp, Artificial Sequence
  Description of Artificial Sequence: Synthetic oligonucleotide
aaggacatcctggaagacgggcggg

SEQ ID NO: 418372 - DNA, 24 bp, Artificial Sequence
  Description of Artificial Sequence: Synthetic oligonucleotide
aggacatcctggaagacgggcggg

SEQ ID NO: 418373 - DNA, 23 bp, Artificial Sequence
  Description of Artificial Sequence: Synthetic oligonucleotide
ggacatcctggaagacgggcggg

SEQ ID NO: 418374 - DNA, 23 bp, Artificial Sequence
  Description of Artificial Sequence: Synthetic oligonucleotide
gacatcctggaagacgggcgggc

SEQ ID NO: 418375 - DNA, 23 bp, Artificial Sequence
  Description of Artificial Sequence: Synthetic oligonucleotide
acatcctggaagacgggcgggcc

SEQ ID NO: 418376 - DNA, 22 bp, Artificial Sequence
  Description of Artificial Sequence: Synthetic oligonucleotide
catcctggaagacgggcgggcc

SEQ ID NO: 418377 - DNA, 22 bp, Artificial Sequence
  Description of Artificial Sequence: Synthetic oligonucleotide
atcctggaagacgggcgggccg

SEQ ID NO: 418378 - DNA, 21 bp, Artificial Sequence
  Description of Artificial Sequence: Synthetic oligonucleotide
tcctggaagacgggcgggccg

SEQ ID NO: 418379 - DNA, 20 bp, Artificial Sequence
  Description of Artificial Sequence: Synthetic oligonucleotide
cctggaagacgggcgggccg

SEQ ID NO: 418380 - DNA, 20 bp, Artificial Sequence
  Description of Artificial Sequence: Synthetic oligonucleotide
ctggaagacgggcgggccgc

SEQ ID NO: 418381 - DNA, 20 bp, Artificial Sequence
  Description of Artificial Sequence: Synthetic oligonucleotide
tggaagacgggcgggccgcg

SEQ ID NO: 418382 - DNA, 20 bp, Artificial Sequence
  Description of Artificial Sequence: Synthetic oligonucleotide
ggaagacgggcgggccgcgt

SEQ ID NO: 418383 - DNA, 20 bp, Artificial Sequence
  Description of Artificial Sequence: Synthetic oligonucleotide
gaagacgggcgggccgcggt

SEQ ID NO: 418384 - DNA, 20 bp, Artificial Sequence
  Description of Artificial Sequence: Synthetic oligonucleotide
aagacgggcgggccgcggtg

SEQ ID NO: 418385 - DNA, 20 bp, Artificial Sequence
  Description of Artificial Sequence: Synthetic oligonucleotide
agacgggcgggccgcggtgt

SEQ ID NO: 418386 - DNA, 20 bp, Artificial Sequence
  Description of Artificial Sequence: Synthetic oligonucleotide
gacgggcgggccgcggtgtt

SEQ ID NO: 418387 - DNA, 20 bp, Artificial Sequence
  Description of Artificial Sequence: Synthetic oligonucleotide
acgggcgggccgcggtggat

SEQ ID NO: 418388 - DNA, 20 bp, Artificial Sequence
  Description of Artificial Sequence: Synthetic oligonucleotide
cgggcgggccgcggtggatt

SEQ ID NO: 418389 - DNA, 20 bp, Artificial Sequence
  Description of Artificial Sequence: Synthetic oligonucleotide
gggcgggccgcggtggacat

SEQ ID NO: 418390 - DNA, 35 bp, Artificial Sequence
  Description of Artificial Sequence: Synthetic oligonucleotide
agatacttctataaccaagaggagtacgtgcgctc

SEQ ID NO: 418391 - DNA, 34 bp, Artificial Sequence
  Description of Artificial Sequence: Synthetic oligonucleotide
gatacttctataaccaagaggagtacgtgcgctc

SEQ ID NO: 418392 - DNA, 34 bp, Artificial Sequence
  Description of Artificial Sequence: Synthetic oligonucleotide
atacttctataaccaagaggagtacgtgcgctcc

SEQ ID NO: 418393 - DNA, 33 bp, Artificial Sequence
  Description of Artificial Sequence: Synthetic oligonucleotide
tacttctataaccaagaggagtacgtgcgctcc

SEQ ID NO: 418394 - DNA, 32 bp, Artificial Sequence
  Description of Artificial Sequence: Synthetic oligonucleotide
acttctataaccaagaggagtacgtgcgctcc

SEQ ID NO: 418395 - DNA, 31 bp, Artificial Sequence
  Description of Artificial Sequence: Synthetic oligonucleotide
cttctataaccaagaggagtacgtgcgctcc

SEQ ID NO: 418396 - DNA, 31 bp, Artificial Sequence
  Description of Artificial Sequence: Synthetic oligonucleotide
ttctataaccaagaggagtacgtgcgctccg

SEQ ID NO: 418397 - DNA, 30 bp, Artificial Sequence
  Description of Artificial Sequence: Synthetic oligonucleotide
tctataaccaagaggagtacgtgcgctccg

SEQ ID NO: 418398 - DNA, 29 bp, Artificial Sequence
  Description of Artificial Sequence: Synthetic oligonucleotide
ctataaccaagaggagtacgtgcgctccg

SEQ ID NO: 418399 - DNA, 30 bp, Artificial Sequence
  Description of Artificial Sequence: Synthetic oligonucleotide
tataaccaagaggagtacgtgcgctccgac

SEQ ID NO: 418400 - DNA, 29 bp, Artificial Sequence
  Description of Artificial Sequence: Synthetic oligonucleotide
ataaccaagaggagtacgtgcgctccgac

SEQ ID NO: 418401 - DNA, 28 bp, Artificial Sequence
  Description of Artificial Sequence: Synthetic oligonucleotide
taaccaagaggagtacgtgcgctccgac

SEQ ID NO: 418402 - DNA, 27 bp, Artificial Sequence
  Description of Artificial Sequence: Synthetic oligonucleotide
aaccaagaggagtacgtgcgctccgac

SEQ ID NO: 418403 - DNA, 27 bp, Artificial Sequence
  Description of Artificial Sequence: Synthetic oligonucleotide
accaagaggagtacgtgcgctccgaca

SEQ ID NO: 418404 - DNA, 26 bp, Artificial Sequence
  Description of Artificial Sequence: Synthetic oligonucleotide
ccaagaggagtacgtgcgctccgaca

SEQ ID NO: 418405 - DNA, 26 bp, Artificial Sequence
  Description of Artificial Sequence: Synthetic oligonucleotide
caagaggagtacgtgcgctccgacag

SEQ ID NO: 418406 - DNA, 26 bp, Artificial Sequence
  Description of Artificial Sequence: Synthetic oligonucleotide
aagaggagtacgtgcgctccgacagc

SEQ ID NO: 418407 - DNA, 25 bp, Artificial Sequence
  Description of Artificial Sequence: Synthetic oligonucleotide
agaggagtacgtgcgctccgacagc

SEQ ID NO: 418408 - DNA, 24 bp, Artificial Sequence
  Description of Artificial Sequence: Synthetic oligonucleotide
gaggagtacgtgcgctccgacagc

SEQ ID NO: 418409 - DNA, 25 bp, Artificial Sequence
  Description of Artificial Sequence: Synthetic oligonucleotide
aggagtacgtgcgctccgacagcga

SEQ ID NO: 418410 - DNA, 24 bp, Artificial Sequence
  Description of Artificial Sequence: Synthetic oligonucleotide
ggagtacgtgcgctccgacagcga

SEQ ID NO: 418411 - DNA, 24 bp, Artificial Sequence
  Description of Artificial Sequence: Synthetic oligonucleotide
gagtacgtgcgctccgacagcgac

SEQ ID NO: 418412 - DNA, 25 bp, Artificial Sequence
  Description of Artificial Sequence: Synthetic oligonucleotide
agtacgtgcgctccgacagcgacgt

SEQ ID NO: 418413 - DNA, 24 bp, Artificial Sequence
  Description of Artificial Sequence: Synthetic oligonucleotide
gtacgtgcgctccgacagcgacgt

SEQ ID NO: 418414 - DNA, 24 bp, Artificial Sequence
  Description of Artificial Sequence: Synthetic oligonucleotide
tacgtgcgctccgacagcgacgtg

SEQ ID NO: 418415 - DNA, 23 bp, Artificial Sequence
  Description of Artificial Sequence: Synthetic oligonucleotide
acgtgcgctccgacagcgacgtg

SEQ ID NO: 418416 - DNA, 22 bp, Artificial Sequence
  Description of Artificial Sequence: Synthetic oligonucleotide
cgtgcgctccgacagcgacgtg

SEQ ID NO: 418417 - DNA, 22 bp, Artificial Sequence
  Description of Artificial Sequence: Synthetic oligonucleotide
gtgcgctccgacagcgacgtgg

SEQ ID NO: 418418 - DNA, 22 bp, Artificial Sequence
  Description of Artificial Sequence: Synthetic oligonucleotide
tgcgctccgacagcgacgtggg

SEQ ID NO: 418419 - DNA, 21 bp, Artificial Sequence
  Description of Artificial Sequence: Synthetic oligonucleotide
gcgctccgacagcgacgtggg

SEQ ID NO: 418420 - DNA, 21 bp, Artificial Sequence
  Description of Artificial Sequence: Synthetic oligonucleotide
cgctccgacagcgacgtgggg

SEQ ID NO: 418421 - DNA, 22 bp, Artificial Sequence
  Description of Artificial Sequence: Synthetic oligonucleotide
gctccgacagcgacgtggggga

SEQ ID NO: 418422 - DNA, 24 bp, Artificial Sequence
  Description of Artificial Sequence: Synthetic oligonucleotide
ctccgacagcgacgtgggggagtt

SEQ ID NO: 418423 - DNA, 24 bp, Artificial Sequence
  Description of Artificial Sequence: Synthetic oligonucleotide
tccgacagcgacgtgggggagttc

SEQ ID NO: 418424 - DNA, 23 bp, Artificial Sequence
  Description of Artificial Sequence: Synthetic oligonucleotide
ccgacagcgacgtgggggagttc

SEQ ID NO: 418425 - DNA, 40 bp, Artificial Sequence
  Description of Artificial Sequence: Synthetic oligonucleotide
caatccaggagcaaggaaatcagtaacttactcctataac

SEQ ID NO: 418426 - DNA, 42 bp, Artificial Sequence
  Description of Artificial Sequence: Synthetic oligonucleotide
aatccaggagcaaggaaatcagtaacttactcctataacttg

SEQ ID NO: 418427 - DNA, 41 bp, Artificial Sequence
  Description of Artificial Sequence: Synthetic oligonucleotide
atccaggagcaaggaaatcagtaacttactcctataacttg

SEQ ID NO: 418428 - DNA, 40 bp, Artificial Sequence
  Description of Artificial Sequence: Synthetic oligonucleotide
tccaggagcaaggaaatcagtaacttactcctataacttg

SEQ ID NO: 418429 - DNA, 39 bp, Artificial Sequence
  Description of Artificial Sequence: Synthetic oligonucleotide
ccaggagcaaggaaatcagtaacttactcctataacttg

SEQ ID NO: 418430 - DNA, 39 bp, Artificial Sequence
  Description of Artificial Sequence: Synthetic oligonucleotide
caggagcaaggaaatcagtaacttactcctataacttgg

SEQ ID NO: 418431 - DNA, 42 bp, Artificial Sequence
  Description of Artificial Sequence: Synthetic oligonucleotide
aggagcaaggaaatcagtaacttactcctataacttggaatg

SEQ ID NO: 418432 - DNA, 41 bp, Artificial Sequence
  Description of Artificial Sequence: Synthetic oligonucleotide
ggagcaaggaaatcagtaacttactcctataacttggaatg

SEQ ID NO: 418433 - DNA, 42 bp, Artificial Sequence
  Description of Artificial Sequence: Synthetic oligonucleotide
gagcaaggaaatcagtaacttactcctataacttggaatgtg

SEQ ID NO: 418434 - DNA, 42 bp, Artificial Sequence
  Description of Artificial Sequence: Synthetic oligonucleotide
agcaaggaaatcagtaacttactcctataacttggaatgtgg

SEQ ID NO: 418435 - DNA, 41 bp, Artificial Sequence
  Description of Artificial Sequence: Synthetic oligonucleotide
gcaaggaaatcagtaacttactcctataacttggaatgtgg

SEQ ID NO: 418436 - DNA, 41 bp, Artificial Sequence
  Description of Artificial Sequence: Synthetic oligonucleotide
caaggaaatcagtaacttactcctataacttggaatgtggg

SEQ ID NO: 418437 - DNA, 42 bp, Artificial Sequence
  Description of Artificial Sequence: Synthetic oligonucleotide
aaggaaatcagtaacttactcctataacttggaatgtgggtg

SEQ ID NO: 418438 - DNA, 41 bp, Artificial Sequence
  Description of Artificial Sequence: Synthetic oligonucleotide
aggaaatcagtaacttactcctataacttggaatgtgggtg

SEQ ID NO: 418439 - DNA, 40 bp, Artificial Sequence
  Description of Artificial Sequence: Synthetic oligonucleotide
ggaaatcagtaacttactcctataacttggaatgtgggtg

SEQ ID NO: 418440 - DNA, 40 bp, Artificial Sequence
  Description of Artificial Sequence: Synthetic oligonucleotide
gaaatcagtaacttactcctataacttggaatgtgggtgg

SEQ ID NO: 418441 - DNA, 41 bp, Artificial Sequence
  Description of Artificial Sequence: Synthetic oligonucleotide
aaatcagtaacttactcctataacttggaatgtgggtggag

SEQ ID NO: 418442 - DNA, 40 bp, Artificial Sequence
  Description of Artificial Sequence: Synthetic oligonucleotide
aatcagtaacttactcctataacttggaatgtgggtggag

SEQ ID NO: 418443 - DNA, 39 bp, Artificial Sequence
  Description of Artificial Sequence: Synthetic oligonucleotide
atcagtaacttactcctataacttggaatgtgggtggag

SEQ ID NO: 418444 - DNA, 38 bp, Artificial Sequence
  Description of Artificial Sequence: Synthetic oligonucleotide
tcagtaacttactcctataacttggaatgtgggtggag

SEQ ID NO: 418445 - DNA, 37 bp, Artificial Sequence
  Description of Artificial Sequence: Synthetic oligonucleotide
cagtaacttactcctataacttggaatgtgggtggag

SEQ ID NO: 418446 - DNA, 37 bp, Artificial Sequence
  Description of Artificial Sequence: Synthetic oligonucleotide
agtaacttactcctataacttggaatgtgggtggagg

SEQ ID NO: 418447 - DNA, 36 bp, Artificial Sequence
  Description of Artificial Sequence: Synthetic oligonucleotide
gtaacttactcctataacttggaatgtgggtggagg

SEQ ID NO: 418448 - DNA, 36 bp, Artificial Sequence
  Description of Artificial Sequence: Synthetic oligonucleotide
taacttactcctataacttggaatgtgggtggaggg

SEQ ID NO: 418449 - DNA, 35 bp, Artificial Sequence
  Description of Artificial Sequence: Synthetic oligonucleotide
aacttactcctataacttggaatgtgggtggaggg

SEQ ID NO: 418450 - DNA, 34 bp, Artificial Sequence
  Description of Artificial Sequence: Synthetic oligonucleotide
acttactcctataacttggaatgtgggtggaggg

SEQ ID NO: 418451 - DNA, 33 bp, Artificial Sequence
  Description of Artificial Sequence: Synthetic oligonucleotide
cttactcctataacttggaatgtgggtggaggg

SEQ ID NO: 418452 - DNA, 33 bp, Artificial Sequence
  Description of Artificial Sequence: Synthetic oligonucleotide
ttactcctataacttggaatgtgggtggagggg

SEQ ID NO: 418453 - DNA, 32 bp, Artificial Sequence
  Description of Artificial Sequence: Synthetic oligonucleotide
tactcctataacttggaatgtgggtggagggg

SEQ ID NO: 418454 - DNA, 31 bp, Artificial Sequence
  Description of Artificial Sequence: Synthetic oligonucleotide
actcctataacttggaatgtgggtggagggg

SEQ ID NO: 418455 - DNA, 30 bp, Artificial Sequence
  Description of Artificial Sequence: Synthetic oligonucleotide
ctcctataacttggaatgtgggtggagggg

SEQ ID NO: 418456 - DNA, 32 bp, Artificial Sequence
  Description of Artificial Sequence: Synthetic oligonucleotide
tcctataacttggaatgtgggtggaggggttc

SEQ ID NO: 418457 - DNA, 27 bp, Artificial Sequence
  Description of Artificial Sequence: Synthetic oligonucleotide
gtggtgtccacgggcctgatccacaat

SEQ ID NO: 418458 - DNA, 27 bp, Artificial Sequence
  Description of Artificial Sequence: Synthetic oligonucleotide
tggtgtccacgggcctgatccacaatg

SEQ ID NO: 418459 - DNA, 26 bp, Artificial Sequence
  Description of Artificial Sequence: Synthetic oligonucleotide
ggtgtccacgggcctgatccacaatg

SEQ ID NO: 418460 - DNA, 27 bp, Artificial Sequence
  Description of Artificial Sequence: Synthetic oligonucleotide
gtgtccacgggcctgatccacaatgga

SEQ ID NO: 418461 - DNA, 27 bp, Artificial Sequence
  Description of Artificial Sequence: Synthetic oligonucleotide
tgtccacgggcctgatccacaatggag

SEQ ID NO: 418462 - DNA, 27 bp, Artificial Sequence
  Description of Artificial Sequence: Synthetic oligonucleotide
gtccacgggcctgatccacaatggaga

SEQ ID NO: 418463 - DNA, 27 bp, Artificial Sequence
  Description of Artificial Sequence: Synthetic oligonucleotide
tccacgggcctgatccacaatggagac

SEQ ID NO: 418464 - DNA, 27 bp, Artificial Sequence
  Description of Artificial Sequence: Synthetic oligonucleotide
ccacgggcctgatccacaatggagact

SEQ ID NO: 418465 - DNA, 27 bp, Artificial Sequence
  Description of Artificial Sequence: Synthetic oligonucleotide
cacgggcctgatccacaatggagactg

SEQ ID NO: 418466 - DNA, 27 bp, Artificial Sequence
  Description of Artificial Sequence: Synthetic oligonucleotide
acgggcctgatccacaatggagactgg

SEQ ID NO: 418467 - DNA, 27 bp, Artificial Sequence
  Description of Artificial Sequence: Synthetic oligonucleotide
cgggcctgatccacaatggagactgga

SEQ ID NO: 418468 - DNA, 27 bp, Artificial Sequence
  Description of Artificial Sequence: Synthetic oligonucleotide
gggcctgatccacaatggagactggac

SEQ ID NO: 418469 - DNA, 26 bp, Artificial Sequence
  Description of Artificial Sequence: Synthetic oligonucleotide
aggaggagctcctgcgcttcgacagt

SEQ ID NO: 418470 - DNA, 25 bp, Artificial Sequence
  Description of Artificial Sequence: Synthetic oligonucleotide
ggaggagctcctgcgcttcgacagt

SEQ ID NO: 418471 - DNA, 26 bp, Artificial Sequence
  Description of Artificial Sequence: Synthetic oligonucleotide
gaggagctcctgcgcttcgacagtga

SEQ ID NO: 418472 - DNA, 26 bp, Artificial Sequence
  Description of Artificial Sequence: Synthetic oligonucleotide
aggagctcctgcgcttcgacagtgac

SEQ ID NO: 418473 - DNA, 25 bp, Artificial Sequence
  Description of Artificial Sequence: Synthetic oligonucleotide
ggagctcctgcgcttcgacagtgac

SEQ ID NO: 418474 - DNA, 26 bp, Artificial Sequence
  Description of Artificial Sequence: Synthetic oligonucleotide
gagctcctgcgcttcgacagtgacgt

SEQ ID NO: 418475 - DNA, 26 bp, Artificial Sequence
  Description of Artificial Sequence: Synthetic oligonucleotide
agctcctgcgcttcgacagtgacgtg

SEQ ID NO: 418476 - DNA, 25 bp, Artificial Sequence
  Description of Artificial Sequence: Synthetic oligonucleotide
gctcctgcgcttcgacagtgacgtg

SEQ ID NO: 418477 - DNA, 25 bp, Artificial Sequence
  Description of Artificial Sequence: Synthetic oligonucleotide
ctcctgcgcttcgacagtgacgtgg

SEQ ID NO: 418478 - DNA, 25 bp, Artificial Sequence
  Description of Artificial Sequence: Synthetic oligonucleotide
tcctgcgcttcgacagtgacgtggg

SEQ ID NO: 418479 - DNA, 24 bp, Artificial Sequence
  Description of Artificial Sequence: Synthetic oligonucleotide
cctgcgcttcgacagtgacgtggg

SEQ ID NO: 418480 - DNA, 24 bp, Artificial Sequence
  Description of Artificial Sequence: Synthetic oligonucleotide
ctgcgcttcgacagtgacgtgggg

SEQ ID NO: 418481 - DNA, 31 bp, Artificial Sequence; identical to SEQ ID NO: 71000
  Description of Artificial Sequence: Synthetic oligonucleotide

SEQ ID NO: 418482 - DNA, 31 bp, Artificial Sequence; identical to SEQ ID NO: 71001
  Description of Artificial Sequence: Synthetic oligonucleotide

SEQ ID NO: 418483 - DNA, 31 bp, Artificial Sequence; identical to SEQ ID NO: 71002
  Description of Artificial Sequence: Synthetic oligonucleotide

SEQ ID NO: 418484 - DNA, 31 bp, Artificial Sequence; identical to SEQ ID NO: 71003
  Description of Artificial Sequence: Synthetic oligonucleotide

SEQ ID NO: 418485 - DNA, 31 bp, Artificial Sequence; identical to SEQ ID NO: 71004
  Description of Artificial Sequence: Synthetic oligonucleotide

SEQ ID NO: 418486 - DNA, 30 bp, Artificial Sequence; identical to SEQ ID NO: 71005
  Description of Artificial Sequence: Synthetic oligonucleotide

SEQ ID NO: 418487 - DNA, 31 bp, Artificial Sequence; identical to SEQ ID NO: 71006
  Description of Artificial Sequence: Synthetic oligonucleotide

SEQ ID NO: 418488 - DNA, 32 bp, Artificial Sequence; identical to SEQ ID NO: 71007
  Description of Artificial Sequence: Synthetic oligonucleotide

SEQ ID NO: 418489 - DNA, 31 bp, Artificial Sequence; identical to SEQ ID NO: 71008
  Description of Artificial Sequence: Synthetic oligonucleotide

SEQ ID NO: 418490 - DNA, 31 bp, Artificial Sequence; identical to SEQ ID NO: 71009
  Description of Artificial Sequence: Synthetic oligonucleotide

SEQ ID NO: 418491 - DNA, 30 bp, Artificial Sequence; identical to SEQ ID NO: 71010
  Description of Artificial Sequence: Synthetic oligonucleotide

SEQ ID NO: 418492 - DNA, 31 bp, Artificial Sequence; identical to SEQ ID NO: 71011
  Description of Artificial Sequence: Synthetic oligonucleotide

SEQ ID NO: 418493 - DNA, 32 bp, Artificial Sequence; identical to SEQ ID NO: 71012
  Description of Artificial Sequence: Synthetic oligonucleotide

SEQ ID NO: 418494 - DNA, 31 bp, Artificial Sequence; identical to SEQ ID NO: 71013
  Description of Artificial Sequence: Synthetic oligonucleotide

SEQ ID NO: 418495 - DNA, 30 bp, Artificial Sequence; identical to SEQ ID NO: 71014
  Description of Artificial Sequence: Synthetic oligonucleotide

SEQ ID NO: 418496 - DNA, 29 bp, Artificial Sequence
  Description of Artificial Sequence: Synthetic oligonucleotide
tgcagacacaactatggggctgtggagag

SEQ ID NO: 418497 - DNA, 28 bp, Artificial Sequence
  Description of Artificial Sequence: Synthetic oligonucleotide
gcagacacaactatggggctgtggagag

SEQ ID NO: 418498 - DNA, 28 bp, Artificial Sequence
  Description of Artificial Sequence: Synthetic oligonucleotide
cagacacaactatggggctgtggagagc

SEQ ID NO: 418499 - DNA, 30 bp, Artificial Sequence; identical to SEQ ID NO: 71018
  Description of Artificial Sequence: Synthetic oligonucleotide

SEQ ID NO: 418500 - DNA, 29 bp, Artificial Sequence
  Description of Artificial Sequence: Synthetic oligonucleotide
gacacaactatggggctgtggagagcttc

SEQ ID NO: 418501 - DNA, 30 bp, Artificial Sequence; identical to SEQ ID NO: 71020
  Description of Artificial Sequence: Synthetic oligonucleotide

SEQ ID NO: 418502 - DNA, 29 bp, Artificial Sequence
  Description of Artificial Sequence: Synthetic oligonucleotide
cacaactatggggctgtggagagcttcac

SEQ ID NO: 418503 - DNA, 30 bp, Artificial Sequence; identical to SEQ ID NO: 71022
  Description of Artificial Sequence: Synthetic oligonucleotide

SEQ ID NO: 418504 - DNA, 29 bp, Artificial Sequence
  Description of Artificial Sequence: Synthetic oligonucleotide
caactatggggctgtggagagcttcacag

SEQ ID NO: 418505 - DNA, 30 bp, Artificial Sequence; identical to SEQ ID NO: 71024
  Description of Artificial Sequence: Synthetic oligonucleotide

SEQ ID NO: 418506 - DNA, 29 bp, Artificial Sequence
  Description of Artificial Sequence: Synthetic oligonucleotide
actatggggctgtggagagcttcacagtg

SEQ ID NO: 418507 - DNA, 28 bp, Artificial Sequence
  Description of Artificial Sequence: Synthetic oligonucleotide
ctatggggctgtggagagcttcacagtg

SEQ ID NO: 418508 - DNA, 28 bp, Artificial Sequence
  Description of Artificial Sequence: Synthetic oligonucleotide
tatggggctgtggagagcttcacagtgc

SEQ ID NO: 418509 - DNA, 27 bp, Artificial Sequence
  Description of Artificial Sequence: Synthetic oligonucleotide
atggggctgtggagagcttcacagtgc

SEQ ID NO: 418510 - DNA, 27 bp, Artificial Sequence
  Description of Artificial Sequence: Synthetic oligonucleotide
tggggctgtggagagcttcacagtgca

SEQ ID NO: 418511 - DNA, 26 bp, Artificial Sequence
  Description of Artificial Sequence: Synthetic oligonucleotide
agctcctgcgcttcgacagcgacgta

SEQ ID NO: 418512 - DNA, 25 bp, Artificial Sequence
  Description of Artificial Sequence: Synthetic oligonucleotide
gctcctgcgcttcgacagcgacgta

SEQ ID NO: 418513 - DNA, 25 bp, Artificial Sequence
  Description of Artificial Sequence: Synthetic oligonucleotide
ctcctgcgcttcgacagcgacgtag

SEQ ID NO: 418514 - DNA, 25 bp, Artificial Sequence
  Description of Artificial Sequence: Synthetic oligonucleotide
tcctgcgcttcgacagcgacgtagg

SEQ ID NO: 418515 - DNA, 24 bp, Artificial Sequence
  Description of Artificial Sequence: Synthetic oligonucleotide
cctgcgcttcgacagcgacgtagg

SEQ ID NO: 418516 - DNA, 24 bp, Artificial Sequence
  Description of Artificial Sequence: Synthetic oligonucleotide
ctgcgcttcgacagcgacgtaggg

SEQ ID NO: 418517 - DNA, 26 bp, Artificial Sequence
  Description of Artificial Sequence: Synthetic oligonucleotide
cgcttcgacagcgacgtaggggagtt

SEQ ID NO: 418518 - DNA, 26 bp, Artificial Sequence
  Description of Artificial Sequence: Synthetic oligonucleotide
gcttcgacagcgacgtaggggagttc

SEQ ID NO: 418519 - DNA, 26 bp, Artificial Sequence
  Description of Artificial Sequence: Synthetic oligonucleotide
cttcgacagcgacgtaggggagttcc

SEQ ID NO: 418520 - DNA, 26 bp, Artificial Sequence
  Description of Artificial Sequence: Synthetic oligonucleotide
ttcgacagcgacgtaggggagttccg

SEQ ID NO: 418521 - DNA, 25 bp, Artificial Sequence
  Description of Artificial Sequence: Synthetic oligonucleotide
tcgacagcgacgtaggggagttccg

SEQ ID NO: 418522 - DNA, 24 bp, Artificial Sequence
  Description of Artificial Sequence: Synthetic oligonucleotide
cgacagcgacgtaggggagttccg

SEQ ID NO: 418523 - DNA, 24 bp, Artificial Sequence
  Description of Artificial Sequence: Synthetic oligonucleotide
gacagcgacgtaggggagttccgg

SEQ ID NO: 418524 - DNA, 24 bp, Artificial Sequence
  Description of Artificial Sequence: Synthetic oligonucleotide
acagcgacgtaggggagttccggg

SEQ ID NO: 418525 - DNA, 23 bp, Artificial Sequence
  Description of Artificial Sequence: Synthetic oligonucleotide
cagcgacgtaggggagttccggg

SEQ ID NO: 418526 - DNA, 23 bp, Artificial Sequence
  Description of Artificial Sequence: Synthetic oligonucleotide
agcgacgtaggggagttccgggc

SEQ ID NO: 418527 - DNA, 22 bp, Artificial Sequence
  Description of Artificial Sequence: Synthetic oligonucleotide
gcgacgtaggggagttccgggc

SEQ ID NO: 418528 - DNA, 22 bp, Artificial Sequence
  Description of Artificial Sequence: Synthetic oligonucleotide
cgacgtaggggagttccgggcg

SEQ ID NO: 418529 - DNA, 23 bp, Artificial Sequence
  Description of Artificial Sequence: Synthetic oligonucleotide
gacgtaggggagttccgggcggt

SEQ ID NO: 418530 - DNA, 24 bp, Artificial Sequence
  Description of Artificial Sequence: Synthetic oligonucleotide
acgtaggggagttccgggcggtga

SEQ ID NO: 418531 - DNA, 23 bp, Artificial Sequence
  Description of Artificial Sequence: Synthetic oligonucleotide
cgtaggggagttccgggcggtga

SEQ ID NO: 418532 - DNA, 23 bp, Artificial Sequence
  Description of Artificial Sequence: Synthetic oligonucleotide
gtaggggagttccgggcggtgac

SEQ ID NO: 418533 - DNA, 23 bp, Artificial Sequence
  Description of Artificial Sequence: Synthetic oligonucleotide
taggggagttccgggcggtgacg

SEQ ID NO: 418534 - DNA, 22 bp, Artificial Sequence
  Description of Artificial Sequence: Synthetic oligonucleotide
aggggagttccgggcggtgacg

SEQ ID NO: 418535 - DNA, 32 bp, Artificial Sequence; identical to SEQ ID NO: 71054
  Description of Artificial Sequence: Synthetic oligonucleotide

SEQ ID NO: 418536 - DNA, 31 bp, Artificial Sequence; identical to SEQ ID NO: 71055
  Description of Artificial Sequence: Synthetic oligonucleotide

SEQ ID NO: 418537 - DNA, 31 bp, Artificial Sequence; identical to SEQ ID NO: 71056
  Description of Artificial Sequence: Synthetic oligonucleotide

SEQ ID NO: 418538 - DNA, 32 bp, Artificial Sequence; identical to SEQ ID NO: 71057
  Description of Artificial Sequence: Synthetic oligonucleotide

SEQ ID NO: 418539 - DNA, 31 bp, Artificial Sequence; identical to SEQ ID NO: 71058
  Description of Artificial Sequence: Synthetic oligonucleotide

SEQ ID NO: 418540 - DNA, 31 bp, Artificial Sequence; identical to SEQ ID NO: 71059
  Description of Artificial Sequence: Synthetic oligonucleotide

SEQ ID NO: 418541 - DNA, 30 bp, Artificial Sequence; identical to SEQ ID NO: 71060
  Description of Artificial Sequence: Synthetic oligonucleotide

SEQ ID NO: 418542 - DNA, 30 bp, Artificial Sequence; identical to SEQ ID NO: 71061
  Description of Artificial Sequence: Synthetic oligonucleotide

SEQ ID NO: 418543 - DNA, 29 bp, Artificial Sequence
  Description of Artificial Sequence: Synthetic oligonucleotide
cacttccataaccaggaggagttcctgcg

SEQ ID NO: 418544 - DNA, 23 bp, Artificial Sequence
  Description of Artificial Sequence: Synthetic oligonucleotide
agtcgggggctttgtgctgggcc

SEQ ID NO: 418545 - DNA, 27 bp, Artificial Sequence
  Description of Artificial Sequence: Synthetic oligonucleotide
ctggaacagccagaaggacatcctggg

SEQ ID NO: 418546 - DNA, 28 bp, Artificial Sequence
  Description of Artificial Sequence: Synthetic oligonucleotide
tggaacagccagaaggacatcctgggag

SEQ ID NO: 418547 - DNA, 27 bp, Artificial Sequence
  Description of Artificial Sequence: Synthetic oligonucleotide
ggaacagccagaaggacatcctgggag

SEQ ID NO: 418548 - DNA, 28 bp, Artificial Sequence
  Description of Artificial Sequence: Synthetic oligonucleotide
gaacagccagaaggacatcctgggagac

SEQ ID NO: 418549 - DNA, 29 bp, Artificial Sequence
  Description of Artificial Sequence: Synthetic oligonucleotide
aacagccagaaggacatcctgggagacag

SEQ ID NO: 418550 - DNA, 28 bp, Artificial Sequence
  Description of Artificial Sequence: Synthetic oligonucleotide
acagccagaaggacatcctgggagacag

SEQ ID NO: 418551 - DNA, 27 bp, Artificial Sequence
  Description of Artificial Sequence: Synthetic oligonucleotide
cagccagaaggacatcctgggagacag

SEQ ID NO: 418552 - DNA, 27 bp, Artificial Sequence
  Description of Artificial Sequence: Synthetic oligonucleotide
agccagaaggacatcctgggagacagg

SEQ ID NO: 418553 - DNA, 26 bp, Artificial Sequence
  Description of Artificial Sequence: Synthetic oligonucleotide
gccagaaggacatcctgggagacagg

SEQ ID NO: 418554 - DNA, 26 bp, Artificial Sequence
  Description of Artificial Sequence: Synthetic oligonucleotide
ccagaaggacatcctgggagacaggc

SEQ ID NO: 418555 - DNA, 26 bp, Artificial Sequence
  Description of Artificial Sequence: Synthetic oligonucleotide
cagaaggacatcctgggagacaggcg

SEQ ID NO: 418556 - DNA, 26 bp, Artificial Sequence
  Description of Artificial Sequence: Synthetic oligonucleotide
agaaggacatcctgggagacaggcgc

SEQ ID NO: 418557 - DNA, 25 bp, Artificial Sequence
  Description of Artificial Sequence: Synthetic oligonucleotide
gaaggacatcctgggagacaggcgc

SEQ ID NO: 418558 - DNA, 25 bp, Artificial Sequence
  Description of Artificial Sequence: Synthetic oligonucleotide
aaggacatcctgggagacaggcgcg

SEQ ID NO: 418559 - DNA, 24 bp, Artificial Sequence
  Description of Artificial Sequence: Synthetic oligonucleotide
aggacatcctgggagacaggcgcg

SEQ ID NO: 418560 - DNA, 23 bp, Artificial Sequence
  Description of Artificial Sequence: Synthetic oligonucleotide
ggacatcctgggagacaggcgcg

SEQ ID NO: 418561 - DNA, 23 bp, Artificial Sequence
  Description of Artificial Sequence: Synthetic oligonucleotide
gacatcctgggagacaggcgcgc

SEQ ID NO: 418562 - DNA, 23 bp, Artificial Sequence
  Description of Artificial Sequence: Synthetic oligonucleotide
acatcctgggagacaggcgcgcc

SEQ ID NO: 418563 - DNA, 22 bp, Artificial Sequence
  Description of Artificial Sequence: Synthetic oligonucleotide
catcctgggagacaggcgcgcc

SEQ ID NO: 418564 - DNA, 22 bp, Artificial Sequence
  Description of Artificial Sequence: Synthetic oligonucleotide
atcctgggagacaggcgcgccg

SEQ ID NO: 418565 - DNA, 21 bp, Artificial Sequence
  Description of Artificial Sequence: Synthetic oligonucleotide
tcctgggagacaggcgcgccg

SEQ ID NO: 418566 - DNA, 20 bp, Artificial Sequence
  Description of Artificial Sequence: Synthetic oligonucleotide
cctgggagacaggcgcgccg

SEQ ID NO: 418567 - DNA, 20 bp, Artificial Sequence
  Description of Artificial Sequence: Synthetic oligonucleotide
ctgggagacaggcgcgccgc

SEQ ID NO: 418568 - DNA, 20 bp, Artificial Sequence
  Description of Artificial Sequence: Synthetic oligonucleotide
tgggagacaggcgcgccgcg

SEQ ID NO: 418569 - DNA, 20 bp, Artificial Sequence
  Description of Artificial Sequence: Synthetic oligonucleotide
gggagacaggcgcgccgcgt

SEQ ID NO: 418570 - DNA, 20 bp, Artificial Sequence
  Description of Artificial Sequence: Synthetic oligonucleotide
ggagacaggcgcgccgcggt

SEQ ID NO: 418571 - DNA, 20 bp, Artificial Sequence
  Description of Artificial Sequence: Synthetic oligonucleotide
gagacaggcgcgccgcggtg

SEQ ID NO: 418572 - DNA, 24 bp, Artificial Sequence
  Description of Artificial Sequence: Synthetic oligonucleotide
gagcgggtgcggttcctggagaga

SEQ ID NO: 418573 - DNA, 25 bp, Artificial Sequence
  Description of Artificial Sequence: Synthetic oligonucleotide
agcgggtgcggttcctggagagaca

SEQ ID NO: 418574 - DNA, 24 bp, Artificial Sequence
  Description of Artificial Sequence: Synthetic oligonucleotide
gcgggtgcggttcctggagagaca

SEQ ID NO: 418575 - DNA, 26 bp, Artificial Sequence
  Description of Artificial Sequence: Synthetic oligonucleotide
cgggtgcggttcctggagagacactt

SEQ ID NO: 418576 - DNA, 26 bp, Artificial Sequence
  Description of Artificial Sequence: Synthetic oligonucleotide
gggtgcggttcctggagagacacttc

SEQ ID NO: 418577 - DNA, 27 bp, Artificial Sequence
  Description of Artificial Sequence: Synthetic oligonucleotide
ggtgcggttcctggagagacacttcca

SEQ ID NO: 418578 - DNA, 30 bp, Artificial Sequence; identical to SEQ ID NO: 71097
  Description of Artificial Sequence: Synthetic oligonucleotide

SEQ ID NO: 418579 - DNA, 30 bp, Artificial Sequence; identical to SEQ ID NO: 71098
  Description of Artificial Sequence: Synthetic oligonucleotide

SEQ ID NO: 418580 - DNA, 29 bp, Artificial Sequence
  Description of Artificial Sequence: Synthetic oligonucleotide
gcggttcctggagagacacttccataacc

SEQ ID NO: 418581 - DNA, 30 bp, Artificial Sequence; identical to SEQ ID NO: 71100
  Description of Artificial Sequence: Synthetic oligonucleotide

SEQ ID NO: 418582 - DNA, 30 bp, Artificial Sequence; identical to SEQ ID NO: 71101
  Description of Artificial Sequence: Synthetic oligonucleotide

SEQ ID NO: 418583 - DNA, 31 bp, Artificial Sequence; identical to SEQ ID NO: 71102
  Description of Artificial Sequence: Synthetic oligonucleotide

SEQ ID NO: 418584 - DNA, 31 bp, Artificial Sequence; identical to SEQ ID NO: 71103
  Description of Artificial Sequence: Synthetic oligonucleotide

SEQ ID NO: 418585 - DNA, 30 bp, Artificial Sequence; identical to SEQ ID NO: 71104
  Description of Artificial Sequence: Synthetic oligonucleotide

SEQ ID NO: 418586 - DNA, 29 bp, Artificial Sequence
  Description of Artificial Sequence: Synthetic oligonucleotide
cctggagagacacttccataaccaggagg

SEQ ID NO: 418587 - DNA, 27 bp, Artificial Sequence
  Description of Artificial Sequence: Synthetic oligonucleotide
ctccctggaggctcctgcatggcaatt

SEQ ID NO: 418588 - DNA, 27 bp, Artificial Sequence
  Description of Artificial Sequence: Synthetic oligonucleotide
tccctggaggctcctgcatggcaattc

SEQ ID NO: 418589 - DNA, 27 bp, Artificial Sequence
  Description of Artificial Sequence: Synthetic oligonucleotide
ccctggaggctcctgcatggcaattct

SEQ ID NO: 418590 - DNA, 27 bp, Artificial Sequence
  Description of Artificial Sequence: Synthetic oligonucleotide
cctggaggctcctgcatggcaattctg

SEQ ID NO: 418591 - DNA, 28 bp, Artificial Sequence
  Description of Artificial Sequence: Synthetic oligonucleotide
ctggaggctcctgcatggcaattctgac

SEQ ID NO: 418592 - DNA, 29 bp, Artificial Sequence
  Description of Artificial Sequence: Synthetic oligonucleotide
tggaggctcctgcatggcaattctgacag

SEQ ID NO: 418593 - DNA, 28 bp, Artificial Sequence
  Description of Artificial Sequence: Synthetic oligonucleotide
ggaggctcctgcatggcaattctgacag

SEQ ID NO: 418594 - DNA, 29 bp, Artificial Sequence
  Description of Artificial Sequence: Synthetic oligonucleotide
gaggctcctgcatggcaattctgacagtg

SEQ ID NO: 418595 - DNA, 30 bp, Artificial Sequence; identical to SEQ ID NO: 71114
  Description of Artificial Sequence: Synthetic oligonucleotide

SEQ ID NO: 418596 - DNA, 29 bp, Artificial Sequence
  Description of Artificial Sequence: Synthetic oligonucleotide
ggctcctgcatggcaattctgacagtgac

SEQ ID NO: 418597 - DNA, 30 bp, Artificial Sequence; identical to SEQ ID NO: 71116
  Description of Artificial Sequence: Synthetic oligonucleotide

SEQ ID NO: 418598 - DNA, 31 bp, Artificial Sequence; identical to SEQ ID NO: 71117
  Description of Artificial Sequence: Synthetic oligonucleotide

SEQ ID NO: 418599 - DNA, 33 bp, Artificial Sequence; identical to SEQ ID NO: 71118
  Description of Artificial Sequence: Synthetic oligonucleotide

SEQ ID NO: 418600 - DNA, 32 bp, Artificial Sequence; identical to SEQ ID NO: 71119
  Description of Artificial Sequence: Synthetic oligonucleotide

SEQ ID NO: 418601 - DNA, 32 bp, Artificial Sequence; identical to SEQ ID NO: 71120
  Description of Artificial Sequence: Synthetic oligonucleotide

SEQ ID NO: 418602 - DNA, 33 bp, Artificial Sequence; identical to SEQ ID NO: 71121
  Description of Artificial Sequence: Synthetic oligonucleotide

SEQ ID NO: 418603 - DNA, 32 bp, Artificial Sequence; identical to SEQ ID NO: 71122
  Description of Artificial Sequence: Synthetic oligonucleotide

SEQ ID NO: 418604 - DNA, 32 bp, Artificial Sequence; identical to SEQ ID NO: 71123
  Description of Artificial Sequence: Synthetic oligonucleotide

SEQ ID NO: 418605 - DNA, 33 bp, Artificial Sequence; identical to SEQ ID NO: 71124
  Description of Artificial Sequence: Synthetic oligonucleotide

SEQ ID NO: 418606 - DNA, 32 bp, Artificial Sequence; identical to SEQ ID NO: 71125
  Description of Artificial Sequence: Synthetic oligonucleotide

SEQ ID NO: 418607 - DNA, 31 bp, Artificial Sequence; identical to SEQ ID NO: 71126
  Description of Artificial Sequence: Synthetic oligonucleotide

SEQ ID NO: 418608 - DNA, 32 bp, Artificial Sequence; identical to SEQ ID NO: 71127
  Description of Artificial Sequence: Synthetic oligonucleotide

SEQ ID NO: 418609 - DNA, 32 bp, Artificial Sequence; identical to SEQ ID NO: 71128
  Description of Artificial Sequence: Synthetic oligonucleotide

SEQ ID NO: 418610 - DNA, 33 bp, Artificial Sequence; identical to SEQ ID NO: 71129
  Description of Artificial Sequence: Synthetic oligonucleotide

SEQ ID NO: 418611 - DNA, 32 bp, Artificial Sequence; identical to SEQ ID NO: 71130
  Description of Artificial Sequence: Synthetic oligonucleotide

SEQ ID NO: 418612 - DNA, 24 bp, Artificial Sequence
  Description of Artificial Sequence: Synthetic oligonucleotide
cttcgacagcgacgtgggggagct

SEQ ID NO: 418613 - DNA, 24 bp, Artificial Sequence
  Description of Artificial Sequence: Synthetic oligonucleotide
ttcgacagcgacgtgggggagctc

SEQ ID NO: 418614 - DNA, 23 bp, Artificial Sequence
  Description of Artificial Sequence: Synthetic oligonucleotide
tcgacagcgacgtgggggagctc

SEQ ID NO: 418615 - DNA, 22 bp, Artificial Sequence
  Description of Artificial Sequence: Synthetic oligonucleotide
cgacagcgacgtgggggagctc

SEQ ID NO: 418616 - DNA, 22 bp, Artificial Sequence
  Description of Artificial Sequence: Synthetic oligonucleotide
gacagcgacgtgggggagctcc

SEQ ID NO: 418617 - DNA, 22 bp, Artificial Sequence
  Description of Artificial Sequence: Synthetic oligonucleotide
acagcgacgtgggggagctccg

SEQ ID NO: 418618 - DNA, 21 bp, Artificial Sequence
  Description of Artificial Sequence: Synthetic oligonucleotide
cagcgacgtgggggagctccg

SEQ ID NO: 418619 - DNA, 21 bp, Artificial Sequence
  Description of Artificial Sequence: Synthetic oligonucleotide
agcgacgtgggggagctccgg

SEQ ID NO: 418620 - DNA, 20 bp, Artificial Sequence
  Description of Artificial Sequence: Synthetic oligonucleotide
gcgacgtgggggagctccgg

SEQ ID NO: 418621 - DNA, 20 bp, Artificial Sequence
  Description of Artificial Sequence: Synthetic oligonucleotide
cgacgtgggggagctccggg

SEQ ID NO: 418622 - DNA, 20 bp, Artificial Sequence
  Description of Artificial Sequence: Synthetic oligonucleotide
gacgtgggggagctccgggc

SEQ ID NO: 418623 - DNA, 20 bp, Artificial Sequence
  Description of Artificial Sequence: Synthetic oligonucleotide
acgtgggggagctccgggcg

SEQ ID NO: 418624 - DNA, 20 bp, Artificial Sequence
  Description of Artificial Sequence: Synthetic oligonucleotide
cgtgggggagctccgggcgt

SEQ ID NO: 418625 - DNA, 20 bp, Artificial Sequence
  Description of Artificial Sequence: Synthetic oligonucleotide
gtgggggagctccgggcggt

SEQ ID NO: 418626 - DNA, 21 bp, Artificial Sequence
  Description of Artificial Sequence: Synthetic oligonucleotide
tgggggagctccgggcggtga

SEQ ID NO: 418627 - DNA, 20 bp, Artificial Sequence
  Description of Artificial Sequence: Synthetic oligonucleotide
gggggagctccgggcggtga

SEQ ID NO: 418628 - DNA, 20 bp, Artificial Sequence
  Description of Artificial Sequence: Synthetic oligonucleotide
ggggagctccgggcggtgac

SEQ ID NO: 418629 - DNA, 20 bp, Artificial Sequence
  Description of Artificial Sequence: Synthetic oligonucleotide
gggagctccgggcggtgacg

SEQ ID NO: 418630 - DNA, 21 bp, Artificial Sequence
  Description of Artificial Sequence: Synthetic oligonucleotide
ggagctccgggcggtgacgga

SEQ ID NO: 418631 - DNA, 21 bp, Artificial Sequence
  Description of Artificial Sequence: Synthetic oligonucleotide
gagctccgggcggtgacggag

SEQ ID NO: 418632 - DNA, 22 bp, Artificial Sequence
  Description of Artificial Sequence: Synthetic oligonucleotide
agctccgggcggtgacggagct

SEQ ID NO: 418633 - DNA, 21 bp, Artificial Sequence
  Description of Artificial Sequence: Synthetic oligonucleotide
gctccgggcggtgacggagct

SEQ ID NO: 418634 - DNA, 21 bp, Artificial Sequence
  Description of Artificial Sequence: Synthetic oligonucleotide
ctccgggcggtgacggagctg

SEQ ID NO: 418635 - DNA, 28 bp, Artificial Sequence
  Description of Artificial Sequence: Synthetic oligonucleotide
ttcaatgggacggagcgggtgctgttac

SEQ ID NO: 418636 - DNA, 27 bp, Artificial Sequence
  Description of Artificial Sequence: Synthetic oligonucleotide
tcaatgggacggagcgggtgctgttac

SEQ ID NO: 418637 - DNA, 27 bp, Artificial Sequence
  Description of Artificial Sequence: Synthetic oligonucleotide
caatgggacggagcgggtgctgttact

SEQ ID NO: 418638 - DNA, 27 bp, Artificial Sequence
  Description of Artificial Sequence: Synthetic oligonucleotide
aatgggacggagcgggtgctgttactg

SEQ ID NO: 418639 - DNA, 26 bp, Artificial Sequence
  Description of Artificial Sequence: Synthetic oligonucleotide
atgggacggagcgggtgctgttactg

SEQ ID NO: 418640 - DNA, 25 bp, Artificial Sequence
  Description of Artificial Sequence: Synthetic oligonucleotide
tgggacggagcgggtgctgttactg

SEQ ID NO: 418641 - DNA, 24 bp, Artificial Sequence
  Description of Artificial Sequence: Synthetic oligonucleotide
gggacggagcgggtgctgttactg

SEQ ID NO: 418642 - DNA, 25 bp, Artificial Sequence
  Description of Artificial Sequence: Synthetic oligonucleotide
ggacggagcgggtgctgttactgga

SEQ ID NO: 418643 - DNA, 26 bp, Artificial Sequence
  Description of Artificial Sequence: Synthetic oligonucleotide
gacggagcgggtgctgttactggaga

SEQ ID NO: 418644 - DNA, 27 bp, Artificial Sequence
  Description of Artificial Sequence: Synthetic oligonucleotide
acggagcgggtgctgttactggagaga

SEQ ID NO: 418645 - DNA, 26 bp, Artificial Sequence
  Description of Artificial Sequence: Synthetic oligonucleotide
cggagcgggtgctgttactggagaga

SEQ ID NO: 418646 - DNA, 27 bp, Artificial Sequence
  Description of Artificial Sequence: Synthetic oligonucleotide
ggagcgggtgctgttactggagagaca

SEQ ID NO: 418647 - DNA, 27 bp, Artificial Sequence
  Description of Artificial Sequence: Synthetic oligonucleotide
gagcgggtgctgttactggagagacac

SEQ ID NO: 418648 - DNA, 29 bp, Artificial Sequence
  Description of Artificial Sequence: Synthetic oligonucleotide
agcgggtgctgttactggagagacacttc

SEQ ID NO: 418649 - DNA, 28 bp, Artificial Sequence
  Description of Artificial Sequence: Synthetic oligonucleotide
gcgggtgctgttactggagagacacttc

SEQ ID NO: 418650 - DNA, 28 bp, Artificial Sequence
  Description of Artificial Sequence: Synthetic oligonucleotide
cgggtgctgttactggagagacacttcc

SEQ ID NO: 418651 - DNA, 32 bp, Artificial Sequence; identical to SEQ ID NO: 71170
  Description of Artificial Sequence: Synthetic oligonucleotide

SEQ ID NO: 418652 - DNA, 32 bp, Artificial Sequence; identical to SEQ ID NO: 71171
  Description of Artificial Sequence: Synthetic oligonucleotide

SEQ ID NO: 418653 - DNA, 33 bp, Artificial Sequence; identical to SEQ ID NO: 71172
  Description of Artificial Sequence: Synthetic oligonucleotide

SEQ ID NO: 418654 - DNA, 33 bp, Artificial Sequence; identical to SEQ ID NO: 71173
  Description of Artificial Sequence: Synthetic oligonucleotide

SEQ ID NO: 418655 - DNA, 32 bp, Artificial Sequence; identical to SEQ ID NO: 71174
  Description of Artificial Sequence: Synthetic oligonucleotide

SEQ ID NO: 418656 - DNA, 33 bp, Artificial Sequence; identical to SEQ ID NO: 71175
  Description of Artificial Sequence: Synthetic oligonucleotide

SEQ ID NO: 418657 - DNA, 33 bp, Artificial Sequence; identical to SEQ ID NO: 71176
  Description of Artificial Sequence: Synthetic oligonucleotide

SEQ ID NO: 418658 - DNA, 31 bp, Artificial Sequence; identical to SEQ ID NO: 71177
  Description of Artificial Sequence: Synthetic oligonucleotide

SEQ ID NO: 418659 - DNA, 32 bp, Artificial Sequence; identical to SEQ ID NO: 71178
  Description of Artificial Sequence: Synthetic oligonucleotide

SEQ ID NO: 418660 - DNA, 31 bp, Artificial Sequence; identical to SEQ ID NO: 71179
  Description of Artificial Sequence: Synthetic oligonucleotide

SEQ ID NO: 418661 - DNA, 31 bp, Artificial Sequence; identical to SEQ ID NO: 71180
  Description of Artificial Sequence: Synthetic oligonucleotide

SEQ ID NO: 418662 - DNA, 30 bp, Artificial Sequence; identical to SEQ ID NO: 71181
  Description of Artificial Sequence: Synthetic oligonucleotide

SEQ ID NO: 418663 - DNA, 30 bp, Artificial Sequence; identical to SEQ ID NO: 71182
  Description of Artificial Sequence: Synthetic oligonucleotide

SEQ ID NO: 418664 - DNA, 29 bp, Artificial Sequence
  Description of Artificial Sequence: Synthetic oligonucleotide
cacttccataaccaggaggagttcgtgcg

SEQ ID NO: 418665 - DNA, 44 bp, Artificial Sequence
  Description of Artificial Sequence: Synthetic oligonucleotide
cacagaatcacattttctagtgttgaaagacctgaaagatcatg

SEQ ID NO: 418666 - DNA, 44 bp, Artificial Sequence
  Description of Artificial Sequence: Synthetic oligonucleotide
acagaatcacattttctagtgttgaaagacctgaaagatcatgg

SEQ ID NO: 418667 - DNA, 43 bp, Artificial Sequence
  Description of Artificial Sequence: Synthetic oligonucleotide
cagaatcacattttctagtgttgaaagacctgaaagatcatgg

SEQ ID NO: 418668 - DNA, 44 bp, Artificial Sequence
  Description of Artificial Sequence: Synthetic oligonucleotide
agaatcacattttctagtgttgaaagacctgaaagatcatggtg

SEQ ID NO: 418669 - DNA, 43 bp, Artificial Sequence
  Description of Artificial Sequence: Synthetic oligonucleotide
gaatcacattttctagtgttgaaagacctgaaagatcatggtg

SEQ ID NO: 418670 - DNA, 43 bp, Artificial Sequence
  Description of Artificial Sequence: Synthetic oligonucleotide
aatcacattttctagtgttgaaagacctgaaagatcatggtgc

SEQ ID NO: 418671 - DNA, 42 bp, Artificial Sequence
  Description of Artificial Sequence: Synthetic oligonucleotide
atcacattttctagtgttgaaagacctgaaagatcatggtgc

SEQ ID NO: 418672 - DNA, 41 bp, Artificial Sequence
  Description of Artificial Sequence: Synthetic oligonucleotide
tcacattttctagtgttgaaagacctgaaagatcatggtgc

SEQ ID NO: 418673 - DNA, 40 bp, Artificial Sequence
  Description of Artificial Sequence: Synthetic oligonucleotide
cacattttctagtgttgaaagacctgaaagatcatggtgc

SEQ ID NO: 418674 - DNA, 40 bp, Artificial Sequence
  Description of Artificial Sequence: Synthetic oligonucleotide
acattttctagtgttgaaagacctgaaagatcatggtgcc

SEQ ID NO: 418675 - DNA, 39 bp, Artificial Sequence
  Description of Artificial Sequence: Synthetic oligonucleotide
cattttctagtgttgaaagacctgaaagatcatggtgcc

SEQ ID NO: 418676 - DNA, 41 bp, Artificial Sequence
  Description of Artificial Sequence: Synthetic oligonucleotide
attttctagtgttgaaagacctgaaagatcatggtgccttc

SEQ ID NO: 418677 - DNA, 40 bp, Artificial Sequence
  Description of Artificial Sequence: Synthetic oligonucleotide
ttttctagtgttgaaagacctgaaagatcatggtgccttc

SEQ ID NO: 418678 - DNA, 39 bp, Artificial Sequence
  Description of Artificial Sequence: Synthetic oligonucleotide
tttctagtgttgaaagacctgaaagatcatggtgccttc

SEQ ID NO: 418679 - DNA, 38 bp, Artificial Sequence
  Description of Artificial Sequence: Synthetic oligonucleotide
ttctagtgttgaaagacctgaaagatcatggtgccttc

SEQ ID NO: 418680 - DNA, 37 bp, Artificial Sequence
  Description of Artificial Sequence: Synthetic oligonucleotide
tctagtgttgaaagacctgaaagatcatggtgccttc

SEQ ID NO: 418681 - DNA, 36 bp, Artificial Sequence
  Description of Artificial Sequence: Synthetic oligonucleotide
ctagtgttgaaagacctgaaagatcatggtgccttc

SEQ ID NO: 418682 - DNA, 40 bp, Artificial Sequence
  Description of Artificial Sequence: Synthetic oligonucleotide
tagtgttgaaagacctgaaagatcatggtgccttcatttc

SEQ ID NO: 418683 - DNA, 39 bp, Artificial Sequence
  Description of Artificial Sequence: Synthetic oligonucleotide
agtgttgaaagacctgaaagatcatggtgccttcatttc

SEQ ID NO: 418684 - DNA, 38 bp, Artificial Sequence
  Description of Artificial Sequence: Synthetic oligonucleotide
gtgttgaaagacctgaaagatcatggtgccttcatttc

SEQ ID NO: 418685 - DNA, 40 bp, Artificial Sequence
  Description of Artificial Sequence: Synthetic oligonucleotide
tgttgaaagacctgaaagatcatggtgccttcatttcaac

SEQ ID NO: 418686 - DNA, 39 bp, Artificial Sequence
  Description of Artificial Sequence: Synthetic oligonucleotide
gttgaaagacctgaaagatcatggtgccttcatttcaac

SEQ ID NO: 418687 - DNA, 40 bp, Artificial Sequence
  Description of Artificial Sequence: Synthetic oligonucleotide
ttgaaagacctgaaagatcatggtgccttcatttcaactg

SEQ ID NO: 418688 - DNA, 39 bp, Artificial Sequence
  Description of Artificial Sequence: Synthetic oligonucleotide
tgaaagacctgaaagatcatggtgccttcatttcaactg

SEQ ID NO: 418689 - DNA, 38 bp, Artificial Sequence
  Description of Artificial Sequence: Synthetic oligonucleotide
gaaagacctgaaagatcatggtgccttcatttcaactg

SEQ ID NO: 418690 - DNA, 39 bp, Artificial Sequence
  Description of Artificial Sequence: Synthetic oligonucleotide
aaagacctgaaagatcatggtgccttcatttcaactgtg

SEQ ID NO: 418691 - DNA, 38 bp, Artificial Sequence
  Description of Artificial Sequence: Synthetic oligonucleotide
aagacctgaaagatcatggtgccttcatttcaactgtg

SEQ ID NO: 418692 - DNA, 37 bp, Artificial Sequence
  Description of Artificial Sequence: Synthetic oligonucleotide
agacctgaaagatcatggtgccttcatttcaactgtg

SEQ ID NO: 418693 - DNA, 36 bp, Artificial Sequence
  Description of Artificial Sequence: Synthetic oligonucleotide
gacctgaaagatcatggtgccttcatttcaactgtg

SEQ ID NO: 418694 - DNA, 37 bp, Artificial Sequence
  Description of Artificial Sequence: Synthetic oligonucleotide
acctgaaagatcatggtgccttcatttcaactgtgag

SEQ ID NO: 418695 - DNA, 36 bp, Artificial Sequence
  Description of Artificial Sequence: Synthetic oligonucleotide
cctgaaagatcatggtgccttcatttcaactgtgag

SEQ ID NO: 418696 - DNA, 37 bp, Artificial Sequence
  Description of Artificial Sequence: Synthetic oligonucleotide
ctgaaagatcatggtgccttcatttcaactgtgagac

SEQ ID NO: 418697 - DNA, 39 bp, Artificial Sequence
  Description of Artificial Sequence: Synthetic oligonucleotide
tgaaagatcatggtgccttcatttcaactgtgagacatg

SEQ ID NO: 418698 - DNA, 38 bp, Artificial Sequence
  Description of Artificial Sequence: Synthetic oligonucleotide
gaaagatcatggtgccttcatttcaactgtgagacatg

SEQ ID NO: 418699 - DNA, 39 bp, Artificial Sequence
  Description of Artificial Sequence: Synthetic oligonucleotide
aaagatcatggtgccttcatttcaactgtgagacatgac

SEQ ID NO: 418700 - DNA, 38 bp, Artificial Sequence
  Description of Artificial Sequence: Synthetic oligonucleotide
aagatcatggtgccttcatttcaactgtgagacatgac

SEQ ID NO: 418701 - DNA, 37 bp, Artificial Sequence
  Description of Artificial Sequence: Synthetic oligonucleotide
agatcatggtgccttcatttcaactgtgagacatgac

SEQ ID NO: 418702 - DNA, 36 bp, Artificial Sequence
  Description of Artificial Sequence: Synthetic oligonucleotide
gatcatggtgccttcatttcaactgtgagacatgac

SEQ ID NO: 418703 - DNA, 36 bp, Artificial Sequence
  Description of Artificial Sequence: Synthetic oligonucleotide
atcatggtgccttcatttcaactgtgagacatgacg

SEQ ID NO: 418704 - DNA, 35 bp, Artificial Sequence
  Description of Artificial Sequence: Synthetic oligonucleotide
tcatggtgccttcatttcaactgtgagacatgacg

SEQ ID NO: 418705 - DNA, 34 bp, Artificial Sequence
  Description of Artificial Sequence: Synthetic oligonucleotide
catggtgccttcatttcaactgtgagacatgacg

SEQ ID NO: 418706 - DNA, 41 bp, Artificial Sequence
  Description of Artificial Sequence: Synthetic oligonucleotide
atggtgccttcatttcaactgtgagacatgacgtaattttc

SEQ ID NO: 418707 - DNA, 40 bp, Artificial Sequence
  Description of Artificial Sequence: Synthetic oligonucleotide
tggtgccttcatttcaactgtgagacatgacgtaattttc

SEQ ID NO: 418708 - DNA, 39 bp, Artificial Sequence
  Description of Artificial Sequence: Synthetic oligonucleotide
ggtgccttcatttcaactgtgagacatgacgtaattttc

SEQ ID NO: 418709 - DNA, 39 bp, Artificial Sequence
  Description of Artificial Sequence: Synthetic oligonucleotide
gtgccttcatttcaactgtgagacatgacgtaattttcc

SEQ ID NO: 418710 - DNA, 39 bp, Artificial Sequence
  Description of Artificial Sequence: Synthetic oligonucleotide
tgccttcatttcaactgtgagacatgacgtaattttccc

SEQ ID NO: 418711 - DNA, 38 bp, Artificial Sequence
  Description of Artificial Sequence: Synthetic oligonucleotide
gccttcatttcaactgtgagacatgacgtaattttccc

SEQ ID NO: 418712 - DNA, 42 bp, Artificial Sequence
  Description of Artificial Sequence: Synthetic oligonucleotide
ccttcatttcaactgtgagacatgacgtaattttcccaaatc

SEQ ID NO: 418713 - DNA, 44 bp, Artificial Sequence
  Description of Artificial Sequence: Synthetic oligonucleotide
cttcatttcaactgtgagacatgacgtaattttcccaaatctac

SEQ ID NO: 418714 - DNA, 46 bp, Artificial Sequence
  Description of Artificial Sequence: Synthetic oligonucleotide
ttcatttcaactgtgagacatgacgtaattttcccaaatctacaac

SEQ ID NO: 418715 - DNA, 45 bp, Artificial Sequence
  Description of Artificial Sequence: Synthetic oligonucleotide
tcatttcaactgtgagacatgacgtaattttcccaaatctacaac

SEQ ID NO: 418716 - DNA, 44 bp, Artificial Sequence
  Description of Artificial Sequence: Synthetic oligonucleotide
catttcaactgtgagacatgacgtaattttcccaaatctacaac

SEQ ID NO: 418717 - DNA, 49 bp, Artificial Sequence
  Description of Artificial Sequence: Synthetic oligonucleotide
atttcaactgtgagacatgacgtaattttcccaaatctacaacattaag

SEQ ID NO: 418718 - DNA, 48 bp, Artificial Sequence
  Description of Artificial Sequence: Synthetic oligonucleotide
tttcaactgtgagacatgacgtaattttcccaaatctacaacattaag

SEQ ID NO: 418719 - DNA, 47 bp, Artificial Sequence
  Description of Artificial Sequence: Synthetic oligonucleotide
ttcaactgtgagacatgacgtaattttcccaaatctacaacattaag

SEQ ID NO: 418720 - DNA, 46 bp, Artificial Sequence
  Description of Artificial Sequence: Synthetic oligonucleotide
tcaactgtgagacatgacgtaattttcccaaatctacaacattaag

SEQ ID NO: 418721 - DNA, 45 bp, Artificial Sequence
  Description of Artificial Sequence: Synthetic oligonucleotide
caactgtgagacatgacgtaattttcccaaatctacaacattaag

SEQ ID NO: 418722 - DNA, 49 bp, Artificial Sequence
  Description of Artificial Sequence: Synthetic oligonucleotide
aactgtgagacatgacgtaattttcccaaatctacaacattaagatatg

SEQ ID NO: 418723 - DNA, 48 bp, Artificial Sequence
  Description of Artificial Sequence: Synthetic oligonucleotide
actgtgagacatgacgtaattttcccaaatctacaacattaagatatg

SEQ ID NO: 418724 - DNA, 47 bp, Artificial Sequence
  Description of Artificial Sequence: Synthetic oligonucleotide
ctgtgagacatgacgtaattttcccaaatctacaacattaagatatg

SEQ ID NO: 418725 - DNA, 47 bp, Artificial Sequence
  Description of Artificial Sequence: Synthetic oligonucleotide
tgtgagacatgacgtaattttcccaaatctacaacattaagatatgg

SEQ ID NO: 418726 - DNA, 46 bp, Artificial Sequence
  Description of Artificial Sequence: Synthetic oligonucleotide
gtgagacatgacgtaattttcccaaatctacaacattaagatatgg

SEQ ID NO: 418727 - DNA, 47 bp, Artificial Sequence
  Description of Artificial Sequence: Synthetic oligonucleotide
tgagacatgacgtaattttcccaaatctacaacattaagatatggtg

SEQ ID NO: 418728 - DNA, 46 bp, Artificial Sequence
  Description of Artificial Sequence: Synthetic oligonucleotide
gagacatgacgtaattttcccaaatctacaacattaagatatggtg

SEQ ID NO: 418729 - DNA, 46 bp, Artificial Sequence
  Description of Artificial Sequence: Synthetic oligonucleotide
agacatgacgtaattttcccaaatctacaacattaagatatggtgc

SEQ ID NO: 418730 - DNA, 45 bp, Artificial Sequence
  Description of Artificial Sequence: Synthetic oligonucleotide
gacatgacgtaattttcccaaatctacaacattaagatatggtgc

SEQ ID NO: 418731 - DNA, 50 bp, Artificial Sequence
  Description of Artificial Sequence: Synthetic oligonucleotide
acatgacgtaattttcccaaatctacaacattaagatatggtgcaataag

SEQ ID NO: 418732 - DNA, 49 bp, Artificial Sequence
  Description of Artificial Sequence: Synthetic oligonucleotide
catgacgtaattttcccaaatctacaacattaagatatggtgcaataag

SEQ ID NO: 418733 - DNA, 49 bp, Artificial Sequence
  Description of Artificial Sequence: Synthetic oligonucleotide
atgacgtaattttcccaaatctacaacattaagatatggtgcaataagg

SEQ ID NO: 418734 - DNA, 48 bp, Artificial Sequence
  Description of Artificial Sequence: Synthetic oligonucleotide
tgacgtaattttcccaaatctacaacattaagatatggtgcaataagg

SEQ ID NO: 418735 - DNA, 47 bp, Artificial Sequence
  Description of Artificial Sequence: Synthetic oligonucleotide
gacgtaattttcccaaatctacaacattaagatatggtgcaataagg

SEQ ID NO: 418736 - DNA, 48 bp, Artificial Sequence
  Description of Artificial Sequence: Synthetic oligonucleotide
acgtaattttcccaaatctacaacattaagatatggtgcaataaggac

SEQ ID NO: 418737 - DNA, 47 bp, Artificial Sequence
  Description of Artificial Sequence: Synthetic oligonucleotide
cgtaattttcccaaatctacaacattaagatatggtgcaataaggac

SEQ ID NO: 418738 - DNA, 36 bp, Artificial Sequence
  Description of Artificial Sequence: Synthetic oligonucleotide
catctcctttactcctaaacacactcacactcactc

SEQ ID NO: 418739 - DNA, 36 bp, Artificial Sequence
  Description of Artificial Sequence: Synthetic oligonucleotide
atctcctttactcctaaacacactcacactcactcc

SEQ ID NO: 418740 - DNA, 35 bp, Artificial Sequence
  Description of Artificial Sequence: Synthetic oligonucleotide
tctcctttactcctaaacacactcacactcactcc

SEQ ID NO: 418741 - DNA, 34 bp, Artificial Sequence
  Description of Artificial Sequence: Synthetic oligonucleotide
ctcctttactcctaaacacactcacactcactcc

SEQ ID NO: 418742 - DNA, 35 bp, Artificial Sequence
  Description of Artificial Sequence: Synthetic oligonucleotide
tcctttactcctaaacacactcacactcactcctg

SEQ ID NO: 418743 - DNA, 34 bp, Artificial Sequence
  Description of Artificial Sequence: Synthetic oligonucleotide
cctttactcctaaacacactcacactcactcctg

SEQ ID NO: 418744 - DNA, 34 bp, Artificial Sequence
  Description of Artificial Sequence: Synthetic oligonucleotide
ctttactcctaaacacactcacactcactcctgc

SEQ ID NO: 418745 - DNA, 39 bp, Artificial Sequence
  Description of Artificial Sequence: Synthetic oligonucleotide
tttactcctaaacacactcacactcactcctgcaaatag

SEQ ID NO: 418746 - DNA, 38 bp, Artificial Sequence
  Description of Artificial Sequence: Synthetic oligonucleotide
ttactcctaaacacactcacactcactcctgcaaatag

SEQ ID NO: 418747 - DNA, 37 bp, Artificial Sequence
  Description of Artificial Sequence: Synthetic oligonucleotide
tactcctaaacacactcacactcactcctgcaaatag

SEQ ID NO: 418748 - DNA, 36 bp, Artificial Sequence
  Description of Artificial Sequence: Synthetic oligonucleotide
actcctaaacacactcacactcactcctgcaaatag

SEQ ID NO: 418749 - DNA, 35 bp, Artificial Sequence
  Description of Artificial Sequence: Synthetic oligonucleotide
ctcctaaacacactcacactcactcctgcaaatag

SEQ ID NO: 418750 - DNA, 37 bp, Artificial Sequence
  Description of Artificial Sequence: Synthetic oligonucleotide
tcctaaacacactcacactcactcctgcaaatagttg

SEQ ID NO: 418751 - DNA, 36 bp, Artificial Sequence
  Description of Artificial Sequence: Synthetic oligonucleotide
cctaaacacactcacactcactcctgcaaatagttg

SEQ ID NO: 418752 - DNA, 37 bp, Artificial Sequence
  Description of Artificial Sequence: Synthetic oligonucleotide
ctaaacacactcacactcactcctgcaaatagttgtc

SEQ ID NO: 418753 - DNA, 39 bp, Artificial Sequence
  Description of Artificial Sequence: Synthetic oligonucleotide
taaacacactcacactcactcctgcaaatagttgtcttg

SEQ ID NO: 418754 - DNA, 38 bp, Artificial Sequence
  Description of Artificial Sequence: Synthetic oligonucleotide
aaacacactcacactcactcctgcaaatagttgtcttg

SEQ ID NO: 418755 - DNA, 37 bp, Artificial Sequence
  Description of Artificial Sequence: Synthetic oligonucleotide
aacacactcacactcactcctgcaaatagttgtcttg

SEQ ID NO: 418756 - DNA, 36 bp, Artificial Sequence
  Description of Artificial Sequence: Synthetic oligonucleotide
acacactcacactcactcctgcaaatagttgtcttg

SEQ ID NO: 418757 - DNA, 35 bp, Artificial Sequence
  Description of Artificial Sequence: Synthetic oligonucleotide
cacactcacactcactcctgcaaatagttgtcttg

SEQ ID NO: 418758 - DNA, 36 bp, Artificial Sequence
  Description of Artificial Sequence: Synthetic oligonucleotide
acactcacactcactcctgcaaatagttgtcttgtc

SEQ ID NO: 418759 - DNA, 35 bp, Artificial Sequence
  Description of Artificial Sequence: Synthetic oligonucleotide
cactcacactcactcctgcaaatagttgtcttgtc

SEQ ID NO: 418760 - DNA, 37 bp, Artificial Sequence
  Description of Artificial Sequence: Synthetic oligonucleotide
actcacactcactcctgcaaatagttgtcttgtcaag

SEQ ID NO: 418761 - DNA, 36 bp, Artificial Sequence
  Description of Artificial Sequence: Synthetic oligonucleotide
ctcacactcactcctgcaaatagttgtcttgtcaag

SEQ ID NO: 418762 - DNA, 37 bp, Artificial Sequence
  Description of Artificial Sequence: Synthetic oligonucleotide
tcacactcactcctgcaaatagttgtcttgtcaagtg

SEQ ID NO: 418763 - DNA, 36 bp, Artificial Sequence
  Description of Artificial Sequence: Synthetic oligonucleotide
cacactcactcctgcaaatagttgtcttgtcaagtg

SEQ ID NO: 418764 - DNA, 36 bp, Artificial Sequence
  Description of Artificial Sequence: Synthetic oligonucleotide
acactcactcctgcaaatagttgtcttgtcaagtgg

SEQ ID NO: 418765 - DNA, 35 bp, Artificial Sequence
  Description of Artificial Sequence: Synthetic oligonucleotide
cactcactcctgcaaatagttgtcttgtcaagtgg

SEQ ID NO: 418766 - DNA, 35 bp, Artificial Sequence
  Description of Artificial Sequence: Synthetic oligonucleotide
actcactcctgcaaatagttgtcttgtcaagtggg

SEQ ID NO: 418767 - DNA, 34 bp, Artificial Sequence
  Description of Artificial Sequence: Synthetic oligonucleotide
ctcactcctgcaaatagttgtcttgtcaagtggg

SEQ ID NO: 418768 - DNA, 38 bp, Artificial Sequence
  Description of Artificial Sequence: Synthetic oligonucleotide
tcactcctgcaaatagttgtcttgtcaagtgggaaatg

SEQ ID NO: 418769 - DNA, 37 bp, Artificial Sequence
  Description of Artificial Sequence: Synthetic oligonucleotide
cactcctgcaaatagttgtcttgtcaagtgggaaatg

SEQ ID NO: 418770 - DNA, 40 bp, Artificial Sequence
  Description of Artificial Sequence: Synthetic oligonucleotide
actcctgcaaatagttgtcttgtcaagtgggaaatgaatg

SEQ ID NO: 418771 - DNA, 39 bp, Artificial Sequence
  Description of Artificial Sequence: Synthetic oligonucleotide
ctcctgcaaatagttgtcttgtcaagtgggaaatgaatg

SEQ ID NO: 418772 - DNA, 39 bp, Artificial Sequence
  Description of Artificial Sequence: Synthetic oligonucleotide
tcctgcaaatagttgtcttgtcaagtgggaaatgaatgc

SEQ ID NO: 418773 - DNA, 38 bp, Artificial Sequence
  Description of Artificial Sequence: Synthetic oligonucleotide
cctgcaaatagttgtcttgtcaagtgggaaatgaatgc

SEQ ID NO: 418774 - DNA, 20 bp, Artificial Sequence
  Description of Artificial Sequence: Synthetic oligonucleotide
ctggggcggcctgtcgccca

SEQ ID NO: 418775 - DNA, 21 bp, Artificial Sequence
  Description of Artificial Sequence: Synthetic oligonucleotide
tggggcggcctgtcgcccagt

SEQ ID NO: 418776 - DNA, 20 bp, Artificial Sequence
  Description of Artificial Sequence: Synthetic oligonucleotide
ggggcggcctgtcgcccagt

SEQ ID NO: 418777 - DNA, 20 bp, Artificial Sequence
  Description of Artificial Sequence: Synthetic oligonucleotide
gggcggcctgtcgcccagtc

SEQ ID NO: 418778 - DNA, 21 bp, Artificial Sequence
  Description of Artificial Sequence: Synthetic oligonucleotide
ggcggcctgtcgcccagtcct

SEQ ID NO: 418779 - DNA, 21 bp, Artificial Sequence
  Description of Artificial Sequence: Synthetic oligonucleotide
gcggcctgtcgcccagtcctg

SEQ ID NO: 418780 - DNA, 23 bp, Artificial Sequence
  Description of Artificial Sequence: Synthetic oligonucleotide
cggcctgtcgcccagtcctggaa

SEQ ID NO: 418781 - DNA, 24 bp, Artificial Sequence
  Description of Artificial Sequence: Synthetic oligonucleotide
ggcctgtcgcccagtcctggaaca

SEQ ID NO: 418782 - DNA, 24 bp, Artificial Sequence
  Description of Artificial Sequence: Synthetic oligonucleotide
gcctgtcgcccagtcctggaacag

SEQ ID NO: 418783 - DNA, 24 bp, Artificial Sequence
  Description of Artificial Sequence: Synthetic oligonucleotide
cctgtcgcccagtcctggaacagc

SEQ ID NO: 418784 - DNA, 25 bp, Artificial Sequence
  Description of Artificial Sequence: Synthetic oligonucleotide
ctgtcgcccagtcctggaacagcca

SEQ ID NO: 418785 - DNA, 27 bp, Artificial Sequence
  Description of Artificial Sequence: Synthetic oligonucleotide
tgtcgcccagtcctggaacagccagaa

SEQ ID NO: 418786 - DNA, 26 bp, Artificial Sequence
  Description of Artificial Sequence: Synthetic oligonucleotide
gtcgcccagtcctggaacagccagaa

SEQ ID NO: 418787 - DNA, 26 bp, Artificial Sequence
  Description of Artificial Sequence: Synthetic oligonucleotide
tcgcccagtcctggaacagccagaag

SEQ ID NO: 418788 - DNA, 25 bp, Artificial Sequence
  Description of Artificial Sequence: Synthetic oligonucleotide
cgcccagtcctggaacagccagaag

SEQ ID NO: 418789 - DNA, 26 bp, Artificial Sequence
  Description of Artificial Sequence: Synthetic oligonucleotide
gcccagtcctggaacagccagaagga

SEQ ID NO: 418790 - DNA, 27 bp, Artificial Sequence
  Description of Artificial Sequence: Synthetic oligonucleotide
cccagtcctggaacagccagaaggact

SEQ ID NO: 418791 - DNA, 28 bp, Artificial Sequence
  Description of Artificial Sequence: Synthetic oligonucleotide
ccagtcctggaacagccagaaggacttc

SEQ ID NO: 418792 - DNA, 28 bp, Artificial Sequence
  Description of Artificial Sequence: Synthetic oligonucleotide
cagtcctggaacagccagaaggacttcc

SEQ ID NO: 418793 - DNA, 38 bp, Artificial Sequence; identical to SEQ ID NO: 71203
  Description of Artificial Sequence: Synthetic oligonucleotide

SEQ ID NO: 418794 - DNA, 40 bp, Artificial Sequence; identical to SEQ ID NO: 71204
  Description of Artificial Sequence: Synthetic oligonucleotide

SEQ ID NO: 418795 - DNA, 39 bp, Artificial Sequence; identical to SEQ ID NO: 71205
  Description of Artificial Sequence: Synthetic oligonucleotide

SEQ ID NO: 418796 - DNA, 42 bp, Artificial Sequence; identical to SEQ ID NO: 71206
  Description of Artificial Sequence: Synthetic oligonucleotide

SEQ ID NO: 418797 - DNA, 42 bp, Artificial Sequence; identical to SEQ ID NO: 71207
  Description of Artificial Sequence: Synthetic oligonucleotide

SEQ ID NO: 418798 - DNA, 41 bp, Artificial Sequence; identical to SEQ ID NO: 71208
  Description of Artificial Sequence: Synthetic oligonucleotide

SEQ ID NO: 418799 - DNA, 40 bp, Artificial Sequence; identical to SEQ ID NO: 71209
  Description of Artificial Sequence: Synthetic oligonucleotide

SEQ ID NO: 418800 - DNA, 39 bp, Artificial Sequence; identical to SEQ ID NO: 71210
  Description of Artificial Sequence: Synthetic oligonucleotide

SEQ ID NO: 418801 - DNA, 39 bp, Artificial Sequence; identical to SEQ ID NO: 71211
  Description of Artificial Sequence: Synthetic oligonucleotide

SEQ ID NO: 418802 - DNA, 38 bp, Artificial Sequence; identical to SEQ ID NO: 71212
  Description of Artificial Sequence: Synthetic oligonucleotide

SEQ ID NO: 418803 - DNA, 37 bp, Artificial Sequence; identical to SEQ ID NO: 71213
  Description of Artificial Sequence: Synthetic oligonucleotide

SEQ ID NO: 418804 - DNA, 38 bp, Artificial Sequence; identical to SEQ ID NO: 71214
  Description of Artificial Sequence: Synthetic oligonucleotide

SEQ ID NO: 418805 - DNA, 38 bp, Artificial Sequence; identical to SEQ ID NO: 71215
  Description of Artificial Sequence: Synthetic oligonucleotide

SEQ ID NO: 418806 - DNA, 37 bp, Artificial Sequence; identical to SEQ ID NO: 71216
  Description of Artificial Sequence: Synthetic oligonucleotide

SEQ ID NO: 418807 - DNA, 37 bp, Artificial Sequence; identical to SEQ ID NO: 71217
  Description of Artificial Sequence: Synthetic oligonucleotide

SEQ ID NO: 418808 - DNA, 36 bp, Artificial Sequence; identical to SEQ ID NO: 71218
  Description of Artificial Sequence: Synthetic oligonucleotide

SEQ ID NO: 418809 - DNA, 35 bp, Artificial Sequence; identical to SEQ ID NO: 71219
  Description of Artificial Sequence: Synthetic oligonucleotide

SEQ ID NO: 418810 - DNA, 36 bp, Artificial Sequence; identical to SEQ ID NO: 71220
  Description of Artificial Sequence: Synthetic oligonucleotide

SEQ ID NO: 418811 - DNA, 35 bp, Artificial Sequence; identical to SEQ ID NO: 71221
  Description of Artificial Sequence: Synthetic oligonucleotide

SEQ ID NO: 418812 - DNA, 35 bp, Artificial Sequence; identical to SEQ ID NO: 71222
  Description of Artificial Sequence: Synthetic oligonucleotide

SEQ ID NO: 418813 - DNA, 34 bp, Artificial Sequence; identical to SEQ ID NO: 71223
  Description of Artificial Sequence: Synthetic oligonucleotide

SEQ ID NO: 418814 - DNA, 33 bp, Artificial Sequence; identical to SEQ ID NO: 71224
  Description of Artificial Sequence: Synthetic oligonucleotide

SEQ ID NO: 418815 - DNA, 33 bp, Artificial Sequence; identical to SEQ ID NO: 71225
  Description of Artificial Sequence: Synthetic oligonucleotide

SEQ ID NO: 418816 - DNA, 33 bp, Artificial Sequence; identical to SEQ ID NO: 71226
  Description of Artificial Sequence: Synthetic oligonucleotide

SEQ ID NO: 418817 - DNA, 25 bp, Artificial Sequence
  Description of Artificial Sequence: Synthetic oligonucleotide
acaggcgcgccgcggtggacaatta

SEQ ID NO: 418818 - DNA, 24 bp, Artificial Sequence
  Description of Artificial Sequence: Synthetic oligonucleotide
caggcgcgccgcggtggacaatta

SEQ ID NO: 418819 - DNA, 25 bp, Artificial Sequence
  Description of Artificial Sequence: Synthetic oligonucleotide
aggcgcgccgcggtggacaattact

SEQ ID NO: 418820 - DNA, 24 bp, Artificial Sequence
  Description of Artificial Sequence: Synthetic oligonucleotide
ggcgcgccgcggtggacaattact

SEQ ID NO: 418821 - DNA, 24 bp, Artificial Sequence
  Description of Artificial Sequence: Synthetic oligonucleotide
gcgcgccgcggtggacaattactg

SEQ ID NO: 418822 - DNA, 25 bp, Artificial Sequence
  Description of Artificial Sequence: Synthetic oligonucleotide
cgcgccgcggtggacaattactgca

SEQ ID NO: 418823 - DNA, 26 bp, Artificial Sequence
  Description of Artificial Sequence: Synthetic oligonucleotide
gcgccgcggtggacaattactgcaga

SEQ ID NO: 418824 - DNA, 27 bp, Artificial Sequence
  Description of Artificial Sequence: Synthetic oligonucleotide
cgccgcggtggacaattactgcagaca

SEQ ID NO: 418825 - DNA, 32 bp, Artificial Sequence; identical to SEQ ID NO: 71235
  Description of Artificial Sequence: Synthetic oligonucleotide

SEQ ID NO: 418826 - DNA, 31 bp, Artificial Sequence; identical to SEQ ID NO: 71236
  Description of Artificial Sequence: Synthetic oligonucleotide

SEQ ID NO: 418827 - DNA, 31 bp, Artificial Sequence; identical to SEQ ID NO: 71237
  Description of Artificial Sequence: Synthetic oligonucleotide

SEQ ID NO: 418828 - DNA, 30 bp, Artificial Sequence; identical to SEQ ID NO: 71238
  Description of Artificial Sequence: Synthetic oligonucleotide

SEQ ID NO: 418829 - DNA, 29 bp, Artificial Sequence
  Description of Artificial Sequence: Synthetic oligonucleotide
atttcttcaatgggacggagcgggtgtgg

SEQ ID NO: 418830 - DNA, 28 bp, Artificial Sequence
  Description of Artificial Sequence: Synthetic oligonucleotide
tttcttcaatgggacggagcgggtgtgg

SEQ ID NO: 418831 - DNA, 27 bp, Artificial Sequence
  Description of Artificial Sequence: Synthetic oligonucleotide
ttcttcaatgggacggagcgggtgtgg

SEQ ID NO: 418832 - DNA, 27 bp, Artificial Sequence
  Description of Artificial Sequence: Synthetic oligonucleotide
tcttcaatgggacggagcgggtgtggt

SEQ ID NO: 418833 - DNA, 27 bp, Artificial Sequence
  Description of Artificial Sequence: Synthetic oligonucleotide
cttcaatgggacggagcgggtgtggtt

SEQ ID NO: 418834 - DNA, 28 bp, Artificial Sequence
  Description of Artificial Sequence: Synthetic oligonucleotide
ttcaatgggacggagcgggtgtggttac

SEQ ID NO: 418835 - DNA, 27 bp, Artificial Sequence
  Description of Artificial Sequence: Synthetic oligonucleotide
tcaatgggacggagcgggtgtggttac

SEQ ID NO: 418836 - DNA, 27 bp, Artificial Sequence
  Description of Artificial Sequence: Synthetic oligonucleotide
caatgggacggagcgggtgtggttact

SEQ ID NO: 418837 - DNA, 27 bp, Artificial Sequence
  Description of Artificial Sequence: Synthetic oligonucleotide
aatgggacggagcgggtgtggttactg

SEQ ID NO: 418838 - DNA, 26 bp, Artificial Sequence
  Description of Artificial Sequence: Synthetic oligonucleotide
atgggacggagcgggtgtggttactg

SEQ ID NO: 418839 - DNA, 25 bp, Artificial Sequence
  Description of Artificial Sequence: Synthetic oligonucleotide
tgggacggagcgggtgtggttactg

SEQ ID NO: 418840 - DNA, 24 bp, Artificial Sequence
  Description of Artificial Sequence: Synthetic oligonucleotide
gggacggagcgggtgtggttactg

SEQ ID NO: 418841 - DNA, 25 bp, Artificial Sequence
  Description of Artificial Sequence: Synthetic oligonucleotide
ggacggagcgggtgtggttactgga

SEQ ID NO: 418842 - DNA, 26 bp, Artificial Sequence
  Description of Artificial Sequence: Synthetic oligonucleotide
gacggagcgggtgtggttactggaga

SEQ ID NO: 418843 - DNA, 27 bp, Artificial Sequence
  Description of Artificial Sequence: Synthetic oligonucleotide
acggagcgggtgtggttactggagaga

SEQ ID NO: 418844 - DNA, 26 bp, Artificial Sequence
  Description of Artificial Sequence: Synthetic oligonucleotide
cggagcgggtgtggttactggagaga

SEQ ID NO: 418845 - DNA, 27 bp, Artificial Sequence
  Description of Artificial Sequence: Synthetic oligonucleotide
ggagcgggtgtggttactggagagaca

SEQ ID NO: 418846 - DNA, 27 bp, Artificial Sequence
  Description of Artificial Sequence: Synthetic oligonucleotide
gagcgggtgtggttactggagagacac

SEQ ID NO: 418847 - DNA, 29 bp, Artificial Sequence
  Description of Artificial Sequence: Synthetic oligonucleotide
agcgggtgtggttactggagagacacttc

SEQ ID NO: 418848 - DNA, 28 bp, Artificial Sequence
  Description of Artificial Sequence: Synthetic oligonucleotide
gcgggtgtggttactggagagacacttc

SEQ ID NO: 418849 - DNA, 28 bp, Artificial Sequence
  Description of Artificial Sequence: Synthetic oligonucleotide
cgggtgtggttactggagagacacttcc

SEQ ID NO: 418850 - DNA, 32 bp, Artificial Sequence; identical to SEQ ID NO: 71260
  Description of Artificial Sequence: Synthetic oligonucleotide

SEQ ID NO: 418851 - DNA, 32 bp, Artificial Sequence; identical to SEQ ID NO: 71261
  Description of Artificial Sequence: Synthetic oligonucleotide

SEQ ID NO: 418852 - DNA, 33 bp, Artificial Sequence; identical to SEQ ID NO: 71262
  Description of Artificial Sequence: Synthetic oligonucleotide

SEQ ID NO: 418853 - DNA, 33 bp, Artificial Sequence; identical to SEQ ID NO: 71263
  Description of Artificial Sequence: Synthetic oligonucleotide

SEQ ID NO: 418854 - DNA, 32 bp, Artificial Sequence; identical to SEQ ID NO: 71264
  Description of Artificial Sequence: Synthetic oligonucleotide

SEQ ID NO: 418855 - DNA, 33 bp, Artificial Sequence; identical to SEQ ID NO: 71265
  Description of Artificial Sequence: Synthetic oligonucleotide

SEQ ID NO: 418856 - DNA, 25 bp, Artificial Sequence
  Description of Artificial Sequence: Synthetic oligonucleotide
tgtcgccgagtcctggaacagccag

SEQ ID NO: 418857 - DNA, 24 bp, Artificial Sequence
  Description of Artificial Sequence: Synthetic oligonucleotide
gtcgccgagtcctggaacagccag

SEQ ID NO: 418858 - DNA, 25 bp, Artificial Sequence
  Description of Artificial Sequence: Synthetic oligonucleotide
tcgccgagtcctggaacagccagca

SEQ ID NO: 418859 - DNA, 24 bp, Artificial Sequence
  Description of Artificial Sequence: Synthetic oligonucleotide
cgccgagtcctggaacagccagca

SEQ ID NO: 418860 - DNA, 24 bp, Artificial Sequence
  Description of Artificial Sequence: Synthetic oligonucleotide
gccgagtcctggaacagccagcag

SEQ ID NO: 418861 - DNA, 25 bp, Artificial Sequence
  Description of Artificial Sequence: Synthetic oligonucleotide
ccgagtcctggaacagccagcagga

SEQ ID NO: 418862 - DNA, 27 bp, Artificial Sequence
  Description of Artificial Sequence: Synthetic oligonucleotide
cgagtcctggaacagccagcaggacat

SEQ ID NO: 418863 - DNA, 27 bp, Artificial Sequence
  Description of Artificial Sequence: Synthetic oligonucleotide
gagtcctggaacagccagcaggacatc

SEQ ID NO: 418864 - DNA, 27 bp, Artificial Sequence
  Description of Artificial Sequence: Synthetic oligonucleotide
agtcctggaacagccagcaggacatcc

SEQ ID NO: 418865 - DNA, 27 bp, Artificial Sequence
  Description of Artificial Sequence: Synthetic oligonucleotide
gtcctggaacagccagcaggacatcct

SEQ ID NO: 418866 - DNA, 27 bp, Artificial Sequence
  Description of Artificial Sequence: Synthetic oligonucleotide
tcctggaacagccagcaggacatcctg

SEQ ID NO: 418867 - DNA, 26 bp, Artificial Sequence
  Description of Artificial Sequence: Synthetic oligonucleotide
cctggaacagccagcaggacatcctg

SEQ ID NO: 418868 - DNA, 27 bp, Artificial Sequence
  Description of Artificial Sequence: Synthetic oligonucleotide
ctggaacagccagcaggacatcctgga

SEQ ID NO: 418869 - DNA, 28 bp, Artificial Sequence
  Description of Artificial Sequence: Synthetic oligonucleotide
tggaacagccagcaggacatcctggaag

SEQ ID NO: 418870 - DNA, 27 bp, Artificial Sequence
  Description of Artificial Sequence: Synthetic oligonucleotide
ggaacagccagcaggacatcctggaag

SEQ ID NO: 418871 - DNA, 28 bp, Artificial Sequence
  Description of Artificial Sequence: Synthetic oligonucleotide
gaacagccagcaggacatcctggaagac

SEQ ID NO: 418872 - DNA, 29 bp, Artificial Sequence
  Description of Artificial Sequence: Synthetic oligonucleotide
aacagccagcaggacatcctggaagacag

SEQ ID NO: 418873 - DNA, 28 bp, Artificial Sequence
  Description of Artificial Sequence: Synthetic oligonucleotide
acagccagcaggacatcctggaagacag

SEQ ID NO: 418874 - DNA, 27 bp, Artificial Sequence
  Description of Artificial Sequence: Synthetic oligonucleotide
cagccagcaggacatcctggaagacag

SEQ ID NO: 418875 - DNA, 27 bp, Artificial Sequence
  Description of Artificial Sequence: Synthetic oligonucleotide
agccagcaggacatcctggaagacagg

SEQ ID NO: 418876 - DNA, 26 bp, Artificial Sequence
  Description of Artificial Sequence: Synthetic oligonucleotide
gccagcaggacatcctggaagacagg

SEQ ID NO: 418877 - DNA, 26 bp, Artificial Sequence
  Description of Artificial Sequence: Synthetic oligonucleotide
ccagcaggacatcctggaagacaggc

SEQ ID NO: 418878 - DNA, 26 bp, Artificial Sequence
  Description of Artificial Sequence: Synthetic oligonucleotide
cagcaggacatcctggaagacaggcg

SEQ ID NO: 418879 - DNA, 26 bp, Artificial Sequence
  Description of Artificial Sequence: Synthetic oligonucleotide
agcaggacatcctggaagacaggcgc

SEQ ID NO: 418880 - DNA, 25 bp, Artificial Sequence
  Description of Artificial Sequence: Synthetic oligonucleotide
gcaggacatcctggaagacaggcgc

SEQ ID NO: 418881 - DNA, 25 bp, Artificial Sequence
  Description of Artificial Sequence: Synthetic oligonucleotide
caggacatcctggaagacaggcgcg

SEQ ID NO: 418882 - DNA, 27 bp, Artificial Sequence
  Description of Artificial Sequence: Synthetic oligonucleotide
ggtgcggttactggagagacacttccg

SEQ ID NO: 418883 - DNA, 30 bp, Artificial Sequence
  Description of Artificial Sequence: Synthetic oligonucleotide
gtgcggttactggagagacacttccgtaac

SEQ ID NO: 418884 - DNA, 30 bp, Artificial Sequence
  Description of Artificial Sequence: Synthetic oligonucleotide
tgcggttactggagagacacttccgtaacc

SEQ ID NO: 418885 - DNA, 29 bp, Artificial Sequence
  Description of Artificial Sequence: Synthetic oligonucleotide
gcggttactggagagacacttccgtaacc

SEQ ID NO: 418886 - DNA, 30 bp, Artificial Sequence
  Description of Artificial Sequence: Synthetic oligonucleotide
cggttactggagagacacttccgtaaccag

SEQ ID NO: 418887 - DNA, 30 bp, Artificial Sequence
  Description of Artificial Sequence: Synthetic oligonucleotide
ggttactggagagacacttccgtaaccagg

SEQ ID NO: 418888 - DNA, 31 bp, Artificial Sequence
  Description of Artificial Sequence: Synthetic oligonucleotide
gttactggagagacacttccgtaaccaggag

SEQ ID NO: 418889 - DNA, 31 bp, Artificial Sequence
  Description of Artificial Sequence: Synthetic oligonucleotide
ttactggagagacacttccgtaaccaggagg

SEQ ID NO: 418890 - DNA, 30 bp, Artificial Sequence
  Description of Artificial Sequence: Synthetic oligonucleotide
tactggagagacacttccgtaaccaggagg

SEQ ID NO: 418891 - DNA, 29 bp, Artificial Sequence
  Description of Artificial Sequence: Synthetic oligonucleotide
actggagagacacttccgtaaccaggagg

SEQ ID NO: 418892 - DNA, 28 bp, Artificial Sequence
  Description of Artificial Sequence: Synthetic oligonucleotide
ctggagagacacttccgtaaccaggagg

SEQ ID NO: 418893 - DNA, 29 bp, Artificial Sequence
  Description of Artificial Sequence: Synthetic oligonucleotide
tggagagacacttccgtaaccaggaggag

SEQ ID NO: 418894 - DNA, 28 bp, Artificial Sequence
  Description of Artificial Sequence: Synthetic oligonucleotide
ggagagacacttccgtaaccaggaggag

SEQ ID NO: 418895 - DNA, 28 bp, Artificial Sequence
  Description of Artificial Sequence: Synthetic oligonucleotide
gagagacacttccgtaaccaggaggagc

SEQ ID NO: 418896 - DNA, 29 bp, Artificial Sequence
  Description of Artificial Sequence: Synthetic oligonucleotide
agagacacttccgtaaccaggaggagctc

SEQ ID NO: 418897 - DNA, 28 bp, Artificial Sequence
  Description of Artificial Sequence: Synthetic oligonucleotide
gagacacttccgtaaccaggaggagctc

SEQ ID NO: 418898 - DNA, 28 bp, Artificial Sequence
  Description of Artificial Sequence: Synthetic oligonucleotide
agacacttccgtaaccaggaggagctcc

SEQ ID NO: 418899 - DNA, 27 bp, Artificial Sequence
  Description of Artificial Sequence: Synthetic oligonucleotide
gacacttccgtaaccaggaggagctcc

SEQ ID NO: 418900 - DNA, 28 bp, Artificial Sequence
  Description of Artificial Sequence: Synthetic oligonucleotide
acacttccgtaaccaggaggagctcctg

SEQ ID NO: 418901 - DNA, 27 bp, Artificial Sequence
  Description of Artificial Sequence: Synthetic oligonucleotide
cacttccgtaaccaggaggagctcctg

SEQ ID NO: 418902 - DNA, 27 bp, Artificial Sequence
  Description of Artificial Sequence: Synthetic oligonucleotide
acttccgtaaccaggaggagctcctgc

SEQ ID NO: 418903 - DNA, 26 bp, Artificial Sequence
  Description of Artificial Sequence: Synthetic oligonucleotide
cttccgtaaccaggaggagctcctgc

SEQ ID NO: 418904 - DNA, 26 bp, Artificial Sequence
  Description of Artificial Sequence: Synthetic oligonucleotide
ttccgtaaccaggaggagctcctgcg

SEQ ID NO: 418905 - DNA, 25 bp, Artificial Sequence
  Description of Artificial Sequence: Synthetic oligonucleotide
tccgtaaccaggaggagctcctgcg

SEQ ID NO: 418906 - DNA, 24 bp, Artificial Sequence
  Description of Artificial Sequence: Synthetic oligonucleotide
ccgtaaccaggaggagctcctgcg

SEQ ID NO: 418907 - DNA, 26 bp, Artificial Sequence
  Description of Artificial Sequence: Synthetic oligonucleotide
cgtaaccaggaggagctcctgcgctt

SEQ ID NO: 418908 - DNA, 26 bp, Artificial Sequence
  Description of Artificial Sequence: Synthetic oligonucleotide
gtaaccaggaggagctcctgcgcttc

SEQ ID NO: 418909 - DNA, 31 bp, Artificial Sequence; identical to SEQ ID NO: 74074
  Description of Artificial Sequence: Synthetic oligonucleotide

SEQ ID NO: 418910 - DNA, 32 bp, Artificial Sequence; identical to SEQ ID NO: 74075
  Description of Artificial Sequence: Synthetic oligonucleotide

SEQ ID NO: 418911 - DNA, 31 bp, Artificial Sequence; identical to SEQ ID NO: 74076
  Description of Artificial Sequence: Synthetic oligonucleotide

SEQ ID NO: 418912 - DNA, 31 bp, Artificial Sequence; identical to SEQ ID NO: 74077
  Description of Artificial Sequence: Synthetic oligonucleotide

SEQ ID NO: 418913 - DNA, 32 bp, Artificial Sequence; identical to SEQ ID NO: 74078
  Description of Artificial Sequence: Synthetic oligonucleotide

SEQ ID NO: 418914 - DNA, 31 bp, Artificial Sequence; identical to SEQ ID NO: 74079
  Description of Artificial Sequence: Synthetic oligonucleotide

SEQ ID NO: 418915 - DNA, 31 bp, Artificial Sequence; identical to SEQ ID NO: 74080
  Description of Artificial Sequence: Synthetic oligonucleotide

SEQ ID NO: 418916 - DNA, 30 bp, Artificial Sequence; identical to SEQ ID NO: 74081
  Description of Artificial Sequence: Synthetic oligonucleotide

SEQ ID NO: 418917 - DNA, 30 bp, Artificial Sequence; identical to SEQ ID NO: 74082
  Description of Artificial Sequence: Synthetic oligonucleotide

SEQ ID NO: 418918 - DNA, 29 bp, Artificial Sequence
  Description of Artificial Sequence: Synthetic oligonucleotide
tacttccataaccaggaggagctcctgcg

SEQ ID NO: 418919 - DNA, 24 bp, Artificial Sequence
  Description of Artificial Sequence: Synthetic oligonucleotide
gacggagcgggtgcggttactgca

SEQ ID NO: 418920 - DNA, 25 bp, Artificial Sequence
  Description of Artificial Sequence: Synthetic oligonucleotide
acggagcgggtgcggttactgcaga

SEQ ID NO: 418921 - DNA, 24 bp, Artificial Sequence
  Description of Artificial Sequence: Synthetic oligonucleotide
cggagcgggtgcggttactgcaga

SEQ ID NO: 418922 - DNA, 25 bp, Artificial Sequence
  Description of Artificial Sequence: Synthetic oligonucleotide
ggagcgggtgcggttactgcagaga

SEQ ID NO: 418923 - DNA, 26 bp, Artificial Sequence
  Description of Artificial Sequence: Synthetic oligonucleotide
gagcgggtgcggttactgcagagaca

SEQ ID NO: 418924 - DNA, 27 bp, Artificial Sequence
  Description of Artificial Sequence: Synthetic oligonucleotide
agcgggtgcggttactgcagagacact

SEQ ID NO: 418925 - DNA, 27 bp, Artificial Sequence
  Description of Artificial Sequence: Synthetic oligonucleotide
gcgggtgcggttactgcagagacactt

SEQ ID NO: 418926 - DNA, 27 bp, Artificial Sequence
  Description of Artificial Sequence: Synthetic oligonucleotide
cgggtgcggttactgcagagacacttc

SEQ ID NO: 418927 - DNA, 27 bp, Artificial Sequence
  Description of Artificial Sequence: Synthetic oligonucleotide
gggtgcggttactgcagagacacttcc

SEQ ID NO: 418928 - DNA, 31 bp, Artificial Sequence
  Description of Artificial Sequence: Synthetic oligonucleotide
ggtgcggttactgcagagacacttccataac

SEQ ID NO: 418929 - DNA, 31 bp, Artificial Sequence
  Description of Artificial Sequence: Synthetic oligonucleotide
gtgcggttactgcagagacacttccataacc

SEQ ID NO: 418930 - DNA, 32 bp, Artificial Sequence
  Description of Artificial Sequence: Synthetic oligonucleotide
tgcggttactgcagagacacttccataaccag

SEQ ID NO: 418931 - DNA, 31 bp, Artificial Sequence
  Description of Artificial Sequence: Synthetic oligonucleotide
gcggttactgcagagacacttccataaccag

SEQ ID NO: 418932 - DNA, 31 bp, Artificial Sequence
  Description of Artificial Sequence: Synthetic oligonucleotide
cggttactgcagagacacttccataaccagg

SEQ ID NO: 418933 - DNA, 32 bp, Artificial Sequence
  Description of Artificial Sequence: Synthetic oligonucleotide
ggttactgcagagacacttccataaccaggag

SEQ ID NO: 418934 - DNA, 32 bp, Artificial Sequence
  Description of Artificial Sequence: Synthetic oligonucleotide
gttactgcagagacacttccataaccaggagg

SEQ ID NO: 418935 - DNA, 33 bp, Artificial Sequence
  Description of Artificial Sequence: Synthetic oligonucleotide
ttactgcagagacacttccataaccaggaggag

SEQ ID NO: 418936 - DNA, 32 bp, Artificial Sequence
  Description of Artificial Sequence: Synthetic oligonucleotide
tactgcagagacacttccataaccaggaggag

SEQ ID NO: 418937 - DNA, 31 bp, Artificial Sequence
  Description of Artificial Sequence: Synthetic oligonucleotide
actgcagagacacttccataaccaggaggag

SEQ ID NO: 418938 - DNA, 30 bp, Artificial Sequence
  Description of Artificial Sequence: Synthetic oligonucleotide
ctgcagagacacttccataaccaggaggag

SEQ ID NO: 418939 - DNA, 30 bp, Artificial Sequence
  Description of Artificial Sequence: Synthetic oligonucleotide
tgcagagacacttccataaccaggaggagc

SEQ ID NO: 418940 - DNA, 29 bp, Artificial Sequence
  Description of Artificial Sequence: Synthetic oligonucleotide
gcagagacacttccataaccaggaggagc

SEQ ID NO: 418941 - DNA, 30 bp, Artificial Sequence
  Description of Artificial Sequence: Synthetic oligonucleotide
cagagacacttccataaccaggaggagctc

SEQ ID NO: 418942 - DNA, 25 bp, Artificial Sequence
  Description of Artificial Sequence: Synthetic oligonucleotide
aggagctcctgcgcttcgacagcgt

SEQ ID NO: 418943 - DNA, 24 bp, Artificial Sequence
  Description of Artificial Sequence: Synthetic oligonucleotide
ggagctcctgcgcttcgacagcgt

SEQ ID NO: 418944 - DNA, 24 bp, Artificial Sequence
  Description of Artificial Sequence: Synthetic oligonucleotide
gagctcctgcgcttcgacagcgtc

SEQ ID NO: 418945 - DNA, 25 bp, Artificial Sequence
  Description of Artificial Sequence: Synthetic oligonucleotide
agctcctgcgcttcgacagcgtcgt

SEQ ID NO: 418946 - DNA, 24 bp, Artificial Sequence
  Description of Artificial Sequence: Synthetic oligonucleotide
gctcctgcgcttcgacagcgtcgt

SEQ ID NO: 418947 - DNA, 24 bp, Artificial Sequence
  Description of Artificial Sequence: Synthetic oligonucleotide
ctcctgcgcttcgacagcgtcgtg

SEQ ID NO: 418948 - DNA, 24 bp, Artificial Sequence
  Description of Artificial Sequence: Synthetic oligonucleotide
tcctgcgcttcgacagcgtcgtgg

SEQ ID NO: 418949 - DNA, 23 bp, Artificial Sequence
  Description of Artificial Sequence: Synthetic oligonucleotide
cctgcgcttcgacagcgtcgtgg

SEQ ID NO: 418950 - DNA, 23 bp, Artificial Sequence
  Description of Artificial Sequence: Synthetic oligonucleotide
ctgcgcttcgacagcgtcgtggg

SEQ ID NO: 418951 - DNA, 23 bp, Artificial Sequence
  Description of Artificial Sequence: Synthetic oligonucleotide
tgcgcttcgacagcgtcgtgggg

SEQ ID NO: 418952 - DNA, 22 bp, Artificial Sequence
  Description of Artificial Sequence: Synthetic oligonucleotide
gcgcttcgacagcgtcgtgggg

SEQ ID NO: 418953 - DNA, 23 bp, Artificial Sequence
  Description of Artificial Sequence: Synthetic oligonucleotide
cgcttcgacagcgtcgtggggga

SEQ ID NO: 418954 - DNA, 25 bp, Artificial Sequence
  Description of Artificial Sequence: Synthetic oligonucleotide
gcttcgacagcgtcgtgggggagtt

SEQ ID NO: 418955 - DNA, 25 bp, Artificial Sequence
  Description of Artificial Sequence: Synthetic oligonucleotide
cttcgacagcgtcgtgggggagttc

SEQ ID NO: 418956 - DNA, 25 bp, Artificial Sequence
  Description of Artificial Sequence: Synthetic oligonucleotide
ttcgacagcgtcgtgggggagttcc

SEQ ID NO: 418957 - DNA, 24 bp, Artificial Sequence
  Description of Artificial Sequence: Synthetic oligonucleotide
tcgacagcgtcgtgggggagttcc

SEQ ID NO: 418958 - DNA, 23 bp, Artificial Sequence
  Description of Artificial Sequence: Synthetic oligonucleotide
cgacagcgtcgtgggggagttcc

SEQ ID NO: 418959 - DNA, 23 bp, Artificial Sequence
  Description of Artificial Sequence: Synthetic oligonucleotide
gacagcgtcgtgggggagttccg

SEQ ID NO: 418960 - DNA, 23 bp, Artificial Sequence
  Description of Artificial Sequence: Synthetic oligonucleotide
acagcgtcgtgggggagttccgg

SEQ ID NO: 418961 - DNA, 22 bp, Artificial Sequence
  Description of Artificial Sequence: Synthetic oligonucleotide
cagcgtcgtgggggagttccgg

SEQ ID NO: 418962 - DNA, 22 bp, Artificial Sequence
  Description of Artificial Sequence: Synthetic oligonucleotide
agcgtcgtgggggagttccggg

SEQ ID NO: 418963 - DNA, 21 bp, Artificial Sequence
  Description of Artificial Sequence: Synthetic oligonucleotide
gcgtcgtgggggagttccggg

SEQ ID NO: 418964 - DNA, 21 bp, Artificial Sequence
  Description of Artificial Sequence: Synthetic oligonucleotide
cgtcgtgggggagttccgggc

SEQ ID NO: 418965 - DNA, 21 bp, Artificial Sequence
  Description of Artificial Sequence: Synthetic oligonucleotide
gtcgtgggggagttccgggcg

SEQ ID NO: 418966 - DNA, 22 bp, Artificial Sequence
  Description of Artificial Sequence: Synthetic oligonucleotide
tcgtgggggagttccgggcggt

SEQ ID NO: 418967 - DNA, 25 bp, Artificial Sequence
  Description of Artificial Sequence: Synthetic oligonucleotide
tcctgcgcttcgacagcgacgtgga

SEQ ID NO: 418968 - DNA, 24 bp, Artificial Sequence
  Description of Artificial Sequence: Synthetic oligonucleotide
cctgcgcttcgacagcgacgtgga

SEQ ID NO: 418969 - DNA, 24 bp, Artificial Sequence
  Description of Artificial Sequence: Synthetic oligonucleotide
ctgcgcttcgacagcgacgtggag

SEQ ID NO: 418970 - DNA, 25 bp, Artificial Sequence
  Description of Artificial Sequence: Synthetic oligonucleotide
tgcgcttcgacagcgacgtggagga

SEQ ID NO: 418971 - DNA, 24 bp, Artificial Sequence
  Description of Artificial Sequence: Synthetic oligonucleotide
gcgcttcgacagcgacgtggagga

SEQ ID NO: 418972 - DNA, 26 bp, Artificial Sequence
  Description of Artificial Sequence: Synthetic oligonucleotide
cgcttcgacagcgacgtggaggagtt

SEQ ID NO: 418973 - DNA, 26 bp, Artificial Sequence
  Description of Artificial Sequence: Synthetic oligonucleotide
gcttcgacagcgacgtggaggagttc

SEQ ID NO: 418974 - DNA, 26 bp, Artificial Sequence
  Description of Artificial Sequence: Synthetic oligonucleotide
cttcgacagcgacgtggaggagttcc

SEQ ID NO: 418975 - DNA, 26 bp, Artificial Sequence
  Description of Artificial Sequence: Synthetic oligonucleotide
ttcgacagcgacgtggaggagttccg

SEQ ID NO: 418976 - DNA, 25 bp, Artificial Sequence
  Description of Artificial Sequence: Synthetic oligonucleotide
tcgacagcgacgtggaggagttccg

SEQ ID NO: 418977 - DNA, 24 bp, Artificial Sequence
  Description of Artificial Sequence: Synthetic oligonucleotide
cgacagcgacgtggaggagttccg

SEQ ID NO: 418978 - DNA, 24 bp, Artificial Sequence
  Description of Artificial Sequence: Synthetic oligonucleotide
gacagcgacgtggaggagttccgg

SEQ ID NO: 418979 - DNA, 24 bp, Artificial Sequence
  Description of Artificial Sequence: Synthetic oligonucleotide
acagcgacgtggaggagttccggg

SEQ ID NO: 418980 - DNA, 23 bp, Artificial Sequence
  Description of Artificial Sequence: Synthetic oligonucleotide
cagcgacgtggaggagttccggg

SEQ ID NO: 418981 - DNA, 23 bp, Artificial Sequence
  Description of Artificial Sequence: Synthetic oligonucleotide
agcgacgtggaggagttccgggc

SEQ ID NO: 418982 - DNA, 22 bp, Artificial Sequence
  Description of Artificial Sequence: Synthetic oligonucleotide
gcgacgtggaggagttccgggc

SEQ ID NO: 418983 - DNA, 22 bp, Artificial Sequence
  Description of Artificial Sequence: Synthetic oligonucleotide
cgacgtggaggagttccgggcg

SEQ ID NO: 418984 - DNA, 23 bp, Artificial Sequence
  Description of Artificial Sequence: Synthetic oligonucleotide
gacgtggaggagttccgggcggt

SEQ ID NO: 418985 - DNA, 24 bp, Artificial Sequence
  Description of Artificial Sequence: Synthetic oligonucleotide
acgtggaggagttccgggcggtga

SEQ ID NO: 418986 - DNA, 23 bp, Artificial Sequence
  Description of Artificial Sequence: Synthetic oligonucleotide
cgtggaggagttccgggcggtga

SEQ ID NO: 418987 - DNA, 23 bp, Artificial Sequence
  Description of Artificial Sequence: Synthetic oligonucleotide
gtggaggagttccgggcggtgac

SEQ ID NO: 418988 - DNA, 23 bp, Artificial Sequence
  Description of Artificial Sequence: Synthetic oligonucleotide
tggaggagttccgggcggtgacg

SEQ ID NO: 418989 - DNA, 22 bp, Artificial Sequence
  Description of Artificial Sequence: Synthetic oligonucleotide
ggaggagttccgggcggtgacg

SEQ ID NO: 418990 - DNA, 23 bp, Artificial Sequence
  Description of Artificial Sequence: Synthetic oligonucleotide
gaggagttccgggcggtgacgga

SEQ ID NO: 418991 - DNA, 23 bp, Artificial Sequence
  Description of Artificial Sequence: Synthetic oligonucleotide
aggagttccgggcggtgacggag

SEQ ID NO: 418992 - DNA, 23 bp, Artificial Sequence
  Description of Artificial Sequence: Synthetic oligonucleotide
gacggagcgggtgcggttactgg

SEQ ID NO: 418993 - DNA, 23 bp, Artificial Sequence
  Description of Artificial Sequence: Synthetic oligonucleotide
acggagcgggtgcggttactggg

SEQ ID NO: 418994 - DNA, 22 bp, Artificial Sequence
  Description of Artificial Sequence: Synthetic oligonucleotide
cggagcgggtgcggttactggg

SEQ ID NO: 418995 - DNA, 23 bp, Artificial Sequence
  Description of Artificial Sequence: Synthetic oligonucleotide
ggagcgggtgcggttactgggga

SEQ ID NO: 418996 - DNA, 24 bp, Artificial Sequence
  Description of Artificial Sequence: Synthetic oligonucleotide
gagcgggtgcggttactggggaga

SEQ ID NO: 418997 - DNA, 25 bp, Artificial Sequence
  Description of Artificial Sequence: Synthetic oligonucleotide
agcgggtgcggttactggggagaca

SEQ ID NO: 418998 - DNA, 24 bp, Artificial Sequence
  Description of Artificial Sequence: Synthetic oligonucleotide
gcgggtgcggttactggggagaca

SEQ ID NO: 418999 - DNA, 26 bp, Artificial Sequence
  Description of Artificial Sequence: Synthetic oligonucleotide
cgggtgcggttactggggagacactt

SEQ ID NO: 419000 - DNA, 26 bp, Artificial Sequence
  Description of Artificial Sequence: Synthetic oligonucleotide
gggtgcggttactggggagacacttc

SEQ ID NO: 419001 - DNA, 27 bp, Artificial Sequence
  Description of Artificial Sequence: Synthetic oligonucleotide
ggtgcggttactggggagacacttcca

SEQ ID NO: 419002 - DNA, 30 bp, Artificial Sequence
  Description of Artificial Sequence: Synthetic oligonucleotide
gtgcggttactggggagacacttccataac

SEQ ID NO: 419003 - DNA, 30 bp, Artificial Sequence
  Description of Artificial Sequence: Synthetic oligonucleotide
tgcggttactggggagacacttccataacc

SEQ ID NO: 419004 - DNA, 29 bp, Artificial Sequence
  Description of Artificial Sequence: Synthetic oligonucleotide
gcggttactggggagacacttccataacc

SEQ ID NO: 419005 - DNA, 30 bp, Artificial Sequence
  Description of Artificial Sequence: Synthetic oligonucleotide
cggttactggggagacacttccataaccag

SEQ ID NO: 419006 - DNA, 30 bp, Artificial Sequence
  Description of Artificial Sequence: Synthetic oligonucleotide
ggttactggggagacacttccataaccagg

SEQ ID NO: 419007 - DNA, 31 bp, Artificial Sequence
  Description of Artificial Sequence: Synthetic oligonucleotide
gttactggggagacacttccataaccaggag

SEQ ID NO: 419008 - DNA, 31 bp, Artificial Sequence
  Description of Artificial Sequence: Synthetic oligonucleotide
ttactggggagacacttccataaccaggagg

SEQ ID NO: 419009 - DNA, 30 bp, Artificial Sequence
  Description of Artificial Sequence: Synthetic oligonucleotide
tactggggagacacttccataaccaggagg

SEQ ID NO: 419010 - DNA, 29 bp, Artificial Sequence
  Description of Artificial Sequence: Synthetic oligonucleotide
actggggagacacttccataaccaggagg

SEQ ID NO: 419011 - DNA, 28 bp, Artificial Sequence
  Description of Artificial Sequence: Synthetic oligonucleotide
ctggggagacacttccataaccaggagg

SEQ ID NO: 419012 - DNA, 29 bp, Artificial Sequence
  Description of Artificial Sequence: Synthetic oligonucleotide
tggggagacacttccataaccaggaggag

SEQ ID NO: 419013 - DNA, 28 bp, Artificial Sequence
  Description of Artificial Sequence: Synthetic oligonucleotide
ggggagacacttccataaccaggaggag

SEQ ID NO: 419014 - DNA, 28 bp, Artificial Sequence
  Description of Artificial Sequence: Synthetic oligonucleotide
gggagacacttccataaccaggaggagc

SEQ ID NO: 419015 - DNA, 29 bp, Artificial Sequence
  Description of Artificial Sequence: Synthetic oligonucleotide
ggagacacttccataaccaggaggagctc

SEQ ID NO: 419016 - DNA, 22 bp, Artificial Sequence
  Description of Artificial Sequence: Synthetic oligonucleotide
agctggggcggcctgtcgccaa

SEQ ID NO: 419017 - DNA, 21 bp, Artificial Sequence
  Description of Artificial Sequence: Synthetic oligonucleotide
gctggggcggcctgtcgccaa

SEQ ID NO: 419018 - DNA, 22 bp, Artificial Sequence
  Description of Artificial Sequence: Synthetic oligonucleotide
ctggggcggcctgtcgccaagt

SEQ ID NO: 419019 - DNA, 22 bp, Artificial Sequence
  Description of Artificial Sequence: Synthetic oligonucleotide
tggggcggcctgtcgccaagtc

SEQ ID NO: 419020 - DNA, 21 bp, Artificial Sequence
  Description of Artificial Sequence: Synthetic oligonucleotide
ggggcggcctgtcgccaagtc

SEQ ID NO: 419021 - DNA, 22 bp, Artificial Sequence
  Description of Artificial Sequence: Synthetic oligonucleotide
gggcggcctgtcgccaagtcct

SEQ ID NO: 419022 - DNA, 22 bp, Artificial Sequence
  Description of Artificial Sequence: Synthetic oligonucleotide
ggcggcctgtcgccaagtcctg

SEQ ID NO: 419023 - DNA, 24 bp, Artificial Sequence
  Description of Artificial Sequence: Synthetic oligonucleotide
gcggcctgtcgccaagtcctggaa

SEQ ID NO: 419024 - DNA, 25 bp, Artificial Sequence
  Description of Artificial Sequence: Synthetic oligonucleotide
cggcctgtcgccaagtcctggaaca

SEQ ID NO: 419025 - DNA, 25 bp, Artificial Sequence
  Description of Artificial Sequence: Synthetic oligonucleotide
ggcctgtcgccaagtcctggaacag

SEQ ID NO: 419026 - DNA, 25 bp, Artificial Sequence
  Description of Artificial Sequence: Synthetic oligonucleotide
gcctgtcgccaagtcctggaacagc

SEQ ID NO: 419027 - DNA, 26 bp, Artificial Sequence
  Description of Artificial Sequence: Synthetic oligonucleotide
cctgtcgccaagtcctggaacagcca

SEQ ID NO: 419028 - DNA, 27 bp, Artificial Sequence
  Description of Artificial Sequence: Synthetic oligonucleotide
ctgtcgccaagtcctggaacagccaga

SEQ ID NO: 419029 - DNA, 28 bp, Artificial Sequence
  Description of Artificial Sequence: Synthetic oligonucleotide
tgtcgccaagtcctggaacagccagaag

SEQ ID NO: 419030 - DNA, 27 bp, Artificial Sequence
  Description of Artificial Sequence: Synthetic oligonucleotide
gtcgccaagtcctggaacagccagaag

SEQ ID NO: 419031 - DNA, 27 bp, Artificial Sequence
  Description of Artificial Sequence: Synthetic oligonucleotide
tcgccaagtcctggaacagccagaagg

SEQ ID NO: 419032 - DNA, 27 bp, Artificial Sequence
  Description of Artificial Sequence: Synthetic oligonucleotide
cgccaagtcctggaacagccagaagga

SEQ ID NO: 419033 - DNA, 27 bp, Artificial Sequence
  Description of Artificial Sequence: Synthetic oligonucleotide
gccaagtcctggaacagccagaaggac

SEQ ID NO: 419034 - DNA, 29 bp, Artificial Sequence
  Description of Artificial Sequence: Synthetic oligonucleotide
ccaagtcctggaacagccagaaggacttc

SEQ ID NO: 419035 - DNA, 29 bp, Artificial Sequence
  Description of Artificial Sequence: Synthetic oligonucleotide
caagtcctggaacagccagaaggacttcc

SEQ ID NO: 419036 - DNA, 30 bp, Artificial Sequence
  Description of Artificial Sequence: Synthetic oligonucleotide
aagtcctggaacagccagaaggacttcctg

SEQ ID NO: 419037 - DNA, 22 bp, Artificial Sequence
  Description of Artificial Sequence: Synthetic oligonucleotide
tgagggagctggggcggcctgt

SEQ ID NO: 419038 - DNA, 21 bp, Artificial Sequence
  Description of Artificial Sequence: Synthetic oligonucleotide
gagggagctggggcggcctgt

SEQ ID NO: 419039 - DNA, 21 bp, Artificial Sequence
  Description of Artificial Sequence: Synthetic oligonucleotide
agggagctggggcggcctgtc

SEQ ID NO: 419040 - DNA, 20 bp, Artificial Sequence
  Description of Artificial Sequence: Synthetic oligonucleotide
gggagctggggcggcctgtc

SEQ ID NO: 419041 - DNA, 35 bp, Artificial Sequence
  Description of Artificial Sequence: Synthetic oligonucleotide
accagattaaggtctcctggtttgcaaccatgttc

SEQ ID NO: 419042 - DNA, 34 bp, Artificial Sequence
  Description of Artificial Sequence: Synthetic oligonucleotide
ccagattaaggtctcctggtttgcaaccatgttc

SEQ ID NO: 419043 - DNA, 34 bp, Artificial Sequence
  Description of Artificial Sequence: Synthetic oligonucleotide
cagattaaggtctcctggtttgcaaccatgttcc

SEQ ID NO: 419044 - DNA, 34 bp, Artificial Sequence
  Description of Artificial Sequence: Synthetic oligonucleotide
agattaaggtctcctggtttgcaaccatgttccc

SEQ ID NO: 419045 - DNA, 33 bp, Artificial Sequence
  Description of Artificial Sequence: Synthetic oligonucleotide
gattaaggtctcctggtttgcaaccatgttccc

SEQ ID NO: 419046 - DNA, 34 bp, Artificial Sequence
  Description of Artificial Sequence: Synthetic oligonucleotide
attaaggtctcctggtttgcaaccatgttccctc

SEQ ID NO: 419047 - DNA, 33 bp, Artificial Sequence
  Description of Artificial Sequence: Synthetic oligonucleotide
ttaaggtctcctggtttgcaaccatgttccctc

SEQ ID NO: 419048 - DNA, 32 bp, Artificial Sequence
  Description of Artificial Sequence: Synthetic oligonucleotide
taaggtctcctggtttgcaaccatgttccctc

SEQ ID NO: 419049 - DNA, 31 bp, Artificial Sequence
  Description of Artificial Sequence: Synthetic oligonucleotide
aaggtctcctggtttgcaaccatgttccctc

SEQ ID NO: 419050 - DNA, 30 bp, Artificial Sequence
  Description of Artificial Sequence: Synthetic oligonucleotide
aggtctcctggtttgcaaccatgttccctc

SEQ ID NO: 419051 - DNA, 29 bp, Artificial Sequence
  Description of Artificial Sequence: Synthetic oligonucleotide
ggtctcctggtttgcaaccatgttccctc

SEQ ID NO: 419052 - DNA, 29 bp, Artificial Sequence
  Description of Artificial Sequence: Synthetic oligonucleotide
gtctcctggtttgcaaccatgttccctcc

SEQ ID NO: 419053 - DNA, 31 bp, Artificial Sequence
  Description of Artificial Sequence: Synthetic oligonucleotide
tctcctggtttgcaaccatgttccctccatc

SEQ ID NO: 419054 - DNA, 30 bp, Artificial Sequence
  Description of Artificial Sequence: Synthetic oligonucleotide
ctcctggtttgcaaccatgttccctccatc

SEQ ID NO: 419055 - DNA, 31 bp, Artificial Sequence
  Description of Artificial Sequence: Synthetic oligonucleotide
tcctggtttgcaaccatgttccctccatctc

SEQ ID NO: 419056 - DNA, 30 bp, Artificial Sequence
  Description of Artificial Sequence: Synthetic oligonucleotide
cctggtttgcaaccatgttccctccatctc

SEQ ID NO: 419057 - DNA, 30 bp, Artificial Sequence
  Description of Artificial Sequence: Synthetic oligonucleotide
ctggtttgcaaccatgttccctccatctcc

SEQ ID NO: 419058 - DNA, 34 bp, Artificial Sequence
  Description of Artificial Sequence: Synthetic oligonucleotide
tggtttgcaaccatgttccctccatctcctttac

SEQ ID NO: 419059 - DNA, 33 bp, Artificial Sequence
  Description of Artificial Sequence: Synthetic oligonucleotide
ggtttgcaaccatgttccctccatctcctttac

SEQ ID NO: 419060 - DNA, 34 bp, Artificial Sequence
  Description of Artificial Sequence: Synthetic oligonucleotide
gtttgcaaccatgttccctccatctcctttactc

SEQ ID NO: 419061 - DNA, 32 bp, Artificial Sequence
  Description of Artificial Sequence: Synthetic oligonucleotide
caaccatgttccctccatctcctttactcctg

SEQ ID NO: 419062 - DNA, 34 bp, Artificial Sequence
  Description of Artificial Sequence: Synthetic oligonucleotide
aaccatgttccctccatctcctttactcctgaac

SEQ ID NO: 419063 - DNA, 33 bp, Artificial Sequence
  Description of Artificial Sequence: Synthetic oligonucleotide
accatgttccctccatctcctttactcctgaac

SEQ ID NO: 419064 - DNA, 32 bp, Artificial Sequence
  Description of Artificial Sequence: Synthetic oligonucleotide
ccatgttccctccatctcctttactcctgaac

SEQ ID NO: 419065 - DNA, 33 bp, Artificial Sequence
  Description of Artificial Sequence: Synthetic oligonucleotide
catgttccctccatctcctttactcctgaacac

SEQ ID NO: 419066 - DNA, 34 bp, Artificial Sequence
  Description of Artificial Sequence: Synthetic oligonucleotide
atgttccctccatctcctttactcctgaacacac

SEQ ID NO: 419067 - DNA, 33 bp, Artificial Sequence
  Description of Artificial Sequence: Synthetic oligonucleotide
tgttccctccatctcctttactcctgaacacac

SEQ ID NO: 419068 - DNA, 35 bp, Artificial Sequence
  Description of Artificial Sequence: Synthetic oligonucleotide
atctcctttactcctgaacacactcacacactctc

SEQ ID NO: 419069 - DNA, 34 bp, Artificial Sequence
  Description of Artificial Sequence: Synthetic oligonucleotide
tctcctttactcctgaacacactcacacactctc

SEQ ID NO: 419070 - DNA, 33 bp, Artificial Sequence
  Description of Artificial Sequence: Synthetic oligonucleotide
ctcctttactcctgaacacactcacacactctc

SEQ ID NO: 419071 - DNA, 34 bp, Artificial Sequence
  Description of Artificial Sequence: Synthetic oligonucleotide
tcctttactcctgaacacactcacacactctctc

SEQ ID NO: 419072 - DNA, 33 bp, Artificial Sequence
  Description of Artificial Sequence: Synthetic oligonucleotide
cctttactcctgaacacactcacacactctctc

SEQ ID NO: 419073 - DNA, 33 bp, Artificial Sequence
  Description of Artificial Sequence: Synthetic oligonucleotide
ctttactcctgaacacactcacacactctctcc

SEQ ID NO: 419074 - DNA, 34 bp, Artificial Sequence
  Description of Artificial Sequence: Synthetic oligonucleotide
tttactcctgaacacactcacacactctctcctg

SEQ ID NO: 419075 - DNA, 33 bp, Artificial Sequence
  Description of Artificial Sequence: Synthetic oligonucleotide
ttactcctgaacacactcacacactctctcctg

SEQ ID NO: 419076 - DNA, 32 bp, Artificial Sequence
  Description of Artificial Sequence: Synthetic oligonucleotide
tactcctgaacacactcacacactctctcctg

SEQ ID NO: 419077 - DNA, 31 bp, Artificial Sequence
  Description of Artificial Sequence: Synthetic oligonucleotide
actcctgaacacactcacacactctctcctg

SEQ ID NO: 419078 - DNA, 30 bp, Artificial Sequence
  Description of Artificial Sequence: Synthetic oligonucleotide
ctcctgaacacactcacacactctctcctg

SEQ ID NO: 419079 - DNA, 30 bp, Artificial Sequence
  Description of Artificial Sequence: Synthetic oligonucleotide
tcctgaacacactcacacactctctcctgc

SEQ ID NO: 419080 - DNA, 29 bp, Artificial Sequence
  Description of Artificial Sequence: Synthetic oligonucleotide
cctgaacacactcacacactctctcctgc

SEQ ID NO: 419081 - DNA, 32 bp, Artificial Sequence
  Description of Artificial Sequence: Synthetic oligonucleotide
ctgaacacactcacacactctctcctgcaaac

SEQ ID NO: 419082 - DNA, 33 bp, Artificial Sequence
  Description of Artificial Sequence: Synthetic oligonucleotide
tgaacacactcacacactctctcctgcaaacag

SEQ ID NO: 419083 - DNA, 32 bp, Artificial Sequence
  Description of Artificial Sequence: Synthetic oligonucleotide
gaacacactcacacactctctcctgcaaacag

SEQ ID NO: 419084 - DNA, 34 bp, Artificial Sequence
  Description of Artificial Sequence: Synthetic oligonucleotide
aacacactcacacactctctcctgcaaacagttc

SEQ ID NO: 419085 - DNA, 33 bp, Artificial Sequence
  Description of Artificial Sequence: Synthetic oligonucleotide
acacactcacacactctctcctgcaaacagttc

SEQ ID NO: 419086 - DNA, 32 bp, Artificial Sequence
  Description of Artificial Sequence: Synthetic oligonucleotide
cacactcacacactctctcctgcaaacagttc

SEQ ID NO: 419087 - DNA, 33 bp, Artificial Sequence
  Description of Artificial Sequence: Synthetic oligonucleotide
acactcacacactctctcctgcaaacagttctc

SEQ ID NO: 419088 - DNA, 32 bp, Artificial Sequence
  Description of Artificial Sequence: Synthetic oligonucleotide
cactcacacactctctcctgcaaacagttctc

SEQ ID NO: 419089 - DNA, 34 bp, Artificial Sequence
  Description of Artificial Sequence: Synthetic oligonucleotide
actcacacactctctcctgcaaacagttctcttg

SEQ ID NO: 419090 - DNA, 33 bp, Artificial Sequence
  Description of Artificial Sequence: Synthetic oligonucleotide
ctcacacactctctcctgcaaacagttctcttg

SEQ ID NO: 419091 - DNA, 34 bp, Artificial Sequence
  Description of Artificial Sequence: Synthetic oligonucleotide
tcacacactctctcctgcaaacagttctcttgtc

SEQ ID NO: 419092 - DNA, 33 bp, Artificial Sequence
  Description of Artificial Sequence: Synthetic oligonucleotide
cacacactctctcctgcaaacagttctcttgtc

SEQ ID NO: 419093 - DNA, 35 bp, Artificial Sequence
  Description of Artificial Sequence: Synthetic oligonucleotide
acacactctctcctgcaaacagttctcttgtcaag

SEQ ID NO: 419094 - DNA, 34 bp, Artificial Sequence
  Description of Artificial Sequence: Synthetic oligonucleotide
cacactctctcctgcaaacagttctcttgtcaag

SEQ ID NO: 419095 - DNA, 35 bp, Artificial Sequence
  Description of Artificial Sequence: Synthetic oligonucleotide
acactctctcctgcaaacagttctcttgtcaagtg

SEQ ID NO: 419096 - DNA, 34 bp, Artificial Sequence
  Description of Artificial Sequence: Synthetic oligonucleotide
cactctctcctgcaaacagttctcttgtcaagtg

SEQ ID NO: 419097 - DNA, 34 bp, Artificial Sequence
  Description of Artificial Sequence: Synthetic oligonucleotide
actctctcctgcaaacagttctcttgtcaagtgg

SEQ ID NO: 419098 - DNA, 33 bp, Artificial Sequence
  Description of Artificial Sequence: Synthetic oligonucleotide
ctctctcctgcaaacagttctcttgtcaagtgg

SEQ ID NO: 419099 - DNA, 33 bp, Artificial Sequence
  Description of Artificial Sequence: Synthetic oligonucleotide
tctctcctgcaaacagttctcttgtcaagtggg

SEQ ID NO: 419100 - DNA, 32 bp, Artificial Sequence
  Description of Artificial Sequence: Synthetic oligonucleotide
ctctcctgcaaacagttctcttgtcaagtggg

SEQ ID NO: 419101 - DNA, 36 bp, Artificial Sequence
  Description of Artificial Sequence: Synthetic oligonucleotide
tctcctgcaaacagttctcttgtcaagtgggaaatg

SEQ ID NO: 419102 - DNA, 27 bp, Artificial Sequence
  Description of Artificial Sequence: Synthetic oligonucleotide
aaggacatcctggaagacgagcgggct

SEQ ID NO: 419103 - DNA, 26 bp, Artificial Sequence
  Description of Artificial Sequence: Synthetic oligonucleotide
aggacatcctggaagacgagcgggct

SEQ ID NO: 419104 - DNA, 25 bp, Artificial Sequence
  Description of Artificial Sequence: Synthetic oligonucleotide
ggacatcctggaagacgagcgggct

SEQ ID NO: 419105 - DNA, 25 bp, Artificial Sequence
  Description of Artificial Sequence: Synthetic oligonucleotide
gacatcctggaagacgagcgggctg

SEQ ID NO: 419106 - DNA, 25 bp, Artificial Sequence
  Description of Artificial Sequence: Synthetic oligonucleotide
acatcctggaagacgagcgggctgc

SEQ ID NO: 419107 - DNA, 24 bp, Artificial Sequence
  Description of Artificial Sequence: Synthetic oligonucleotide
catcctggaagacgagcgggctgc

SEQ ID NO: 419108 - DNA, 24 bp, Artificial Sequence
  Description of Artificial Sequence: Synthetic oligonucleotide
atcctggaagacgagcgggctgcg

SEQ ID NO: 419109 - DNA, 23 bp, Artificial Sequence
  Description of Artificial Sequence: Synthetic oligonucleotide
tcctggaagacgagcgggctgcg

SEQ ID NO: 419110 - DNA, 22 bp, Artificial Sequence
  Description of Artificial Sequence: Synthetic oligonucleotide
cctggaagacgagcgggctgcg

SEQ ID NO: 419111 - DNA, 23 bp, Artificial Sequence
  Description of Artificial Sequence: Synthetic oligonucleotide
ctggaagacgagcgggctgcggt

SEQ ID NO: 419112 - DNA, 23 bp, Artificial Sequence
  Description of Artificial Sequence: Synthetic oligonucleotide
tggaagacgagcgggctgcggtg

SEQ ID NO: 419113 - DNA, 22 bp, Artificial Sequence
  Description of Artificial Sequence: Synthetic oligonucleotide
ggaagacgagcgggctgcggtg

SEQ ID NO: 419114 - DNA, 23 bp, Artificial Sequence
  Description of Artificial Sequence: Synthetic oligonucleotide
gaagacgagcgggctgcggtgga

SEQ ID NO: 419115 - DNA, 24 bp, Artificial Sequence
  Description of Artificial Sequence: Synthetic oligonucleotide
aagacgagcgggctgcggtggaca

SEQ ID NO: 419116 - DNA, 23 bp, Artificial Sequence
  Description of Artificial Sequence: Synthetic oligonucleotide
agacgagcgggctgcggtggaca

SEQ ID NO: 419117 - DNA, 22 bp, Artificial Sequence
  Description of Artificial Sequence: Synthetic oligonucleotide
gacgagcgggctgcggtggaca

SEQ ID NO: 419118 - DNA, 22 bp, Artificial Sequence
  Description of Artificial Sequence: Synthetic oligonucleotide
acgagcgggctgcggtggacac

SEQ ID NO: 419119 - DNA, 21 bp, Artificial Sequence
  Description of Artificial Sequence: Synthetic oligonucleotide
cgagcgggctgcggtggacac

SEQ ID NO: 419120 - DNA, 23 bp, Artificial Sequence
  Description of Artificial Sequence: Synthetic oligonucleotide
gagcgggctgcggtggacaccta

SEQ ID NO: 419121 - DNA, 24 bp, Artificial Sequence
  Description of Artificial Sequence: Synthetic oligonucleotide
agcgggctgcggtggacacctact

SEQ ID NO: 419122 - DNA, 23 bp, Artificial Sequence
  Description of Artificial Sequence: Synthetic oligonucleotide
gcgggctgcggtggacacctact

SEQ ID NO: 419123 - DNA, 23 bp, Artificial Sequence
  Description of Artificial Sequence: Synthetic oligonucleotide
cgggctgcggtggacacctactg

SEQ ID NO: 419124 - DNA, 24 bp, Artificial Sequence
  Description of Artificial Sequence: Synthetic oligonucleotide
gggctgcggtggacacctactgca

SEQ ID NO: 419125 - DNA, 25 bp, Artificial Sequence
  Description of Artificial Sequence: Synthetic oligonucleotide
ggctgcggtggacacctactgcaga

SEQ ID NO: 419126 - DNA, 26 bp, Artificial Sequence
  Description of Artificial Sequence: Synthetic oligonucleotide
gctgcggtggacacctactgcagaca

SEQ ID NO: 419127 - DNA, 27 bp, Artificial Sequence
  Description of Artificial Sequence: Synthetic oligonucleotide
ctgcggtggacacctactgcagacaca

SEQ ID NO: 419128 - DNA, 28 bp, Artificial Sequence
  Description of Artificial Sequence: Synthetic oligonucleotide
tgcggtggacacctactgcagacacaac

SEQ ID NO: 419129 - DNA, 24 bp, Artificial Sequence
  Description of Artificial Sequence: Synthetic oligonucleotide
agcgggccgcggtggacacctatt

SEQ ID NO: 419130 - DNA, 21 bp, Artificial Sequence
  Description of Artificial Sequence: Synthetic oligonucleotide
ggggagttccgggcggtgacc

SEQ ID NO: 419131 - DNA, 22 bp, Artificial Sequence
  Description of Artificial Sequence: Synthetic oligonucleotide
gggagttccgggcggtgaccga

SEQ ID NO: 419132 - DNA, 22 bp, Artificial Sequence
  Description of Artificial Sequence: Synthetic oligonucleotide
ggagttccgggcggtgaccgag

SEQ ID NO: 419133 - DNA, 23 bp, Artificial Sequence
  Description of Artificial Sequence: Synthetic oligonucleotide
gagttccgggcggtgaccgagct

SEQ ID NO: 419134 - DNA, 23 bp, Artificial Sequence
  Description of Artificial Sequence: Synthetic oligonucleotide
agttccgggcggtgaccgagctg

SEQ ID NO: 419135 - DNA, 22 bp, Artificial Sequence
  Description of Artificial Sequence: Synthetic oligonucleotide
gttccgggcggtgaccgagctg

SEQ ID NO: 419136 - DNA, 22 bp, Artificial Sequence
  Description of Artificial Sequence: Synthetic oligonucleotide
ttccgggcggtgaccgagctgg

SEQ ID NO: 419137 - DNA, 21 bp, Artificial Sequence
  Description of Artificial Sequence: Synthetic oligonucleotide
tccgggcggtgaccgagctgg

SEQ ID NO: 419138 - DNA, 20 bp, Artificial Sequence
  Description of Artificial Sequence: Synthetic oligonucleotide
ccgggcggtgaccgagctgg

SEQ ID NO: 419139 - DNA, 20 bp, Artificial Sequence
  Description of Artificial Sequence: Synthetic oligonucleotide
cgggcggtgaccgagctggg

SEQ ID NO: 419140 - DNA, 20 bp, Artificial Sequence
  Description of Artificial Sequence: Synthetic oligonucleotide
gggcggtgaccgagctgggg

SEQ ID NO: 419141 - DNA, 20 bp, Artificial Sequence
  Description of Artificial Sequence: Synthetic oligonucleotide
ggcggtgaccgagctggggc

SEQ ID NO: 419142 - DNA, 20 bp, Artificial Sequence
  Description of Artificial Sequence: Synthetic oligonucleotide
gcggtgaccgagctggggcg

SEQ ID NO: 419143 - DNA, 20 bp, Artificial Sequence
  Description of Artificial Sequence: Synthetic oligonucleotide
cggtgaccgagctggggcgg

SEQ ID NO: 419144 - DNA, 20 bp, Artificial Sequence
  Description of Artificial Sequence: Synthetic oligonucleotide
ggtgaccgagctggggcggc

SEQ ID NO: 419145 - DNA, 21 bp, Artificial Sequence
  Description of Artificial Sequence: Synthetic oligonucleotide
gtgaccgagctggggcggcct

SEQ ID NO: 419146 - DNA, 23 bp, Artificial Sequence
  Description of Artificial Sequence: Synthetic oligonucleotide
tgaccgagctggggcggcctgat

SEQ ID NO: 419147 - DNA, 22 bp, Artificial Sequence
  Description of Artificial Sequence: Synthetic oligonucleotide
gaccgagctggggcggcctgat

SEQ ID NO: 419148 - DNA, 22 bp, Artificial Sequence
  Description of Artificial Sequence: Synthetic oligonucleotide
accgagctggggcggcctgatg

SEQ ID NO: 419149 - DNA, 21 bp, Artificial Sequence
  Description of Artificial Sequence: Synthetic oligonucleotide
ccgagctggggcggcctgatg

SEQ ID NO: 419150 - DNA, 21 bp, Artificial Sequence
  Description of Artificial Sequence: Synthetic oligonucleotide
cgagctggggcggcctgatgc

SEQ ID NO: 419151 - DNA, 31 bp, Artificial Sequence; identical to SEQ ID NO: 71337
  Description of Artificial Sequence: Synthetic oligonucleotide

SEQ ID NO: 419152 - DNA, 33 bp, Artificial Sequence; identical to SEQ ID NO: 71338
  Description of Artificial Sequence: Synthetic oligonucleotide

SEQ ID NO: 419153 - DNA, 32 bp, Artificial Sequence; identical to SEQ ID NO: 71339
  Description of Artificial Sequence: Synthetic oligonucleotide

SEQ ID NO: 419154 - DNA, 33 bp, Artificial Sequence; identical to SEQ ID NO: 71340
  Description of Artificial Sequence: Synthetic oligonucleotide

SEQ ID NO: 419155 - DNA, 32 bp, Artificial Sequence; identical to SEQ ID NO: 71341
  Description of Artificial Sequence: Synthetic oligonucleotide

SEQ ID NO: 419156 - DNA, 31 bp, Artificial Sequence; identical to SEQ ID NO: 71342
  Description of Artificial Sequence: Synthetic oligonucleotide

SEQ ID NO: 419157 - DNA, 31 bp, Artificial Sequence; identical to SEQ ID NO: 71343
  Description of Artificial Sequence: Synthetic oligonucleotide

SEQ ID NO: 419158 - DNA, 30 bp, Artificial Sequence; identical to SEQ ID NO: 71344
  Description of Artificial Sequence: Synthetic oligonucleotide

SEQ ID NO: 419159 - DNA, 31 bp, Artificial Sequence; identical to SEQ ID NO: 71345
  Description of Artificial Sequence: Synthetic oligonucleotide

SEQ ID NO: 419160 - DNA, 31 bp, Artificial Sequence; identical to SEQ ID NO: 71346
  Description of Artificial Sequence: Synthetic oligonucleotide

SEQ ID NO: 419161 - DNA, 30 bp, Artificial Sequence; identical to SEQ ID NO: 71347
  Description of Artificial Sequence: Synthetic oligonucleotide

SEQ ID NO: 419162 - DNA, 29 bp, Artificial Sequence
  Description of Artificial Sequence: Synthetic oligonucleotide
cagccagaaggacatcctagaagacgagc

SEQ ID NO: 419163 - DNA, 29 bp, Artificial Sequence
  Description of Artificial Sequence: Synthetic oligonucleotide
agccagaaggacatcctagaagacgagcg

SEQ ID NO: 419164 - DNA, 28 bp, Artificial Sequence
  Description of Artificial Sequence: Synthetic oligonucleotide
gccagaaggacatcctagaagacgagcg

SEQ ID NO: 419165 - DNA, 28 bp, Artificial Sequence
  Description of Artificial Sequence: Synthetic oligonucleotide
ccagaaggacatcctagaagacgagcgg

SEQ ID NO: 419166 - DNA, 28 bp, Artificial Sequence
  Description of Artificial Sequence: Synthetic oligonucleotide
cagaaggacatcctagaagacgagcggg

SEQ ID NO: 419167 - DNA, 28 bp, Artificial Sequence
  Description of Artificial Sequence: Synthetic oligonucleotide
agaaggacatcctagaagacgagcgggc

SEQ ID NO: 419168 - DNA, 27 bp, Artificial Sequence
  Description of Artificial Sequence: Synthetic oligonucleotide
gaaggacatcctagaagacgagcgggc

SEQ ID NO: 419169 - DNA, 27 bp, Artificial Sequence
  Description of Artificial Sequence: Synthetic oligonucleotide
aaggacatcctagaagacgagcgggcc

SEQ ID NO: 419170 - DNA, 26 bp, Artificial Sequence
  Description of Artificial Sequence: Synthetic oligonucleotide
aggacatcctagaagacgagcgggcc

SEQ ID NO: 419171 - DNA, 25 bp, Artificial Sequence
  Description of Artificial Sequence: Synthetic oligonucleotide
ggacatcctagaagacgagcgggcc

SEQ ID NO: 419172 - DNA, 25 bp, Artificial Sequence
  Description of Artificial Sequence: Synthetic oligonucleotide
gacatcctagaagacgagcgggccg

SEQ ID NO: 419173 - DNA, 25 bp, Artificial Sequence
  Description of Artificial Sequence: Synthetic oligonucleotide
acatcctagaagacgagcgggccgc

SEQ ID NO: 419174 - DNA, 24 bp, Artificial Sequence
  Description of Artificial Sequence: Synthetic oligonucleotide
catcctagaagacgagcgggccgc

SEQ ID NO: 419175 - DNA, 24 bp, Artificial Sequence
  Description of Artificial Sequence: Synthetic oligonucleotide
atcctagaagacgagcgggccgcg

SEQ ID NO: 419176 - DNA, 23 bp, Artificial Sequence
  Description of Artificial Sequence: Synthetic oligonucleotide
tcctagaagacgagcgggccgcg

SEQ ID NO: 419177 - DNA, 22 bp, Artificial Sequence
  Description of Artificial Sequence: Synthetic oligonucleotide
cctagaagacgagcgggccgcg

SEQ ID NO: 419178 - DNA, 23 bp, Artificial Sequence
  Description of Artificial Sequence: Synthetic oligonucleotide
ctagaagacgagcgggccgcggt

SEQ ID NO: 419179 - DNA, 23 bp, Artificial Sequence
  Description of Artificial Sequence: Synthetic oligonucleotide
tagaagacgagcgggccgcggtg

SEQ ID NO: 419180 - DNA, 22 bp, Artificial Sequence
  Description of Artificial Sequence: Synthetic oligonucleotide
agaagacgagcgggccgcggtg

SEQ ID NO: 419181 - DNA, 27 bp, Artificial Sequence
  Description of Artificial Sequence: Synthetic oligonucleotide
cagaaggacatcctggaagacgagcgc

SEQ ID NO: 419182 - DNA, 27 bp, Artificial Sequence
  Description of Artificial Sequence: Synthetic oligonucleotide
agaaggacatcctggaagacgagcgcg

SEQ ID NO: 419183 - DNA, 26 bp, Artificial Sequence
  Description of Artificial Sequence: Synthetic oligonucleotide
gaaggacatcctggaagacgagcgcg

SEQ ID NO: 419184 - DNA, 26 bp, Artificial Sequence
  Description of Artificial Sequence: Synthetic oligonucleotide
aaggacatcctggaagacgagcgcgc

SEQ ID NO: 419185 - DNA, 25 bp, Artificial Sequence
  Description of Artificial Sequence: Synthetic oligonucleotide
aggacatcctggaagacgagcgcgc

SEQ ID NO: 419186 - DNA, 24 bp, Artificial Sequence
  Description of Artificial Sequence: Synthetic oligonucleotide
ggacatcctggaagacgagcgcgc

SEQ ID NO: 419187 - DNA, 24 bp, Artificial Sequence
  Description of Artificial Sequence: Synthetic oligonucleotide
gacatcctggaagacgagcgcgcc

SEQ ID NO: 419188 - DNA, 24 bp, Artificial Sequence
  Description of Artificial Sequence: Synthetic oligonucleotide
acatcctggaagacgagcgcgccg

SEQ ID NO: 419189 - DNA, 23 bp, Artificial Sequence
  Description of Artificial Sequence: Synthetic oligonucleotide
catcctggaagacgagcgcgccg

SEQ ID NO: 419190 - DNA, 23 bp, Artificial Sequence
  Description of Artificial Sequence: Synthetic oligonucleotide
atcctggaagacgagcgcgccgc

SEQ ID NO: 419191 - DNA, 22 bp, Artificial Sequence
  Description of Artificial Sequence: Synthetic oligonucleotide
tcctggaagacgagcgcgccgc

SEQ ID NO: 419192 - DNA, 21 bp, Artificial Sequence
  Description of Artificial Sequence: Synthetic oligonucleotide
cctggaagacgagcgcgccgc

SEQ ID NO: 419193 - DNA, 21 bp, Artificial Sequence
  Description of Artificial Sequence: Synthetic oligonucleotide
ctggaagacgagcgcgccgcg

SEQ ID NO: 419194 - DNA, 22 bp, Artificial Sequence
  Description of Artificial Sequence: Synthetic oligonucleotide
tggaagacgagcgcgccgcggt

SEQ ID NO: 419195 - DNA, 21 bp, Artificial Sequence
  Description of Artificial Sequence: Synthetic oligonucleotide
ggaagacgagcgcgccgcggt

SEQ ID NO: 419196 - DNA, 21 bp, Artificial Sequence
  Description of Artificial Sequence: Synthetic oligonucleotide
gaagacgagcgcgccgcggtg

SEQ ID NO: 419197 - DNA, 22 bp, Artificial Sequence
  Description of Artificial Sequence: Synthetic oligonucleotide
aagacgagcgcgccgcggtgga

SEQ ID NO: 419198 - DNA, 21 bp, Artificial Sequence
  Description of Artificial Sequence: Synthetic oligonucleotide
agacgagcgcgccgcggtgga

SEQ ID NO: 419199 - DNA, 20 bp, Artificial Sequence
  Description of Artificial Sequence: Synthetic oligonucleotide
gacgagcgcgccgcggtgga

SEQ ID NO: 419200 - DNA, 21 bp, Artificial Sequence
  Description of Artificial Sequence: Synthetic oligonucleotide
acgagcgcgccgcggtggaca

SEQ ID NO: 419201 - DNA, 20 bp, Artificial Sequence
  Description of Artificial Sequence: Synthetic oligonucleotide
cgagcgcgccgcggtggaca

SEQ ID NO: 419202 - DNA, 20 bp, Artificial Sequence
  Description of Artificial Sequence: Synthetic oligonucleotide
gagcgcgccgcggtggacac

SEQ ID NO: 419203 - DNA, 22 bp, Artificial Sequence
  Description of Artificial Sequence: Synthetic oligonucleotide
agcgcgccgcggtggacaccta

SEQ ID NO: 419204 - DNA, 28 bp, Artificial Sequence
  Description of Artificial Sequence: Synthetic oligonucleotide
ctactgcagacacaactacggggttggg

SEQ ID NO: 419205 - DNA, 28 bp, Artificial Sequence
  Description of Artificial Sequence: Synthetic oligonucleotide
tactgcagacacaactacggggttgggg

SEQ ID NO: 419206 - DNA, 27 bp, Artificial Sequence
  Description of Artificial Sequence: Synthetic oligonucleotide
actgcagacacaactacggggttgggg

SEQ ID NO: 419207 - DNA, 27 bp, Artificial Sequence
  Description of Artificial Sequence: Synthetic oligonucleotide
ctgcagacacaactacggggttgggga

SEQ ID NO: 419208 - DNA, 27 bp, Artificial Sequence
  Description of Artificial Sequence: Synthetic oligonucleotide
tgcagacacaactacggggttggggag

SEQ ID NO: 419209 - DNA, 27 bp, Artificial Sequence
  Description of Artificial Sequence: Synthetic oligonucleotide
gcagacacaactacggggttggggaga

SEQ ID NO: 419210 - DNA, 27 bp, Artificial Sequence
  Description of Artificial Sequence: Synthetic oligonucleotide
cagacacaactacggggttggggagag

SEQ ID NO: 419211 - DNA, 27 bp, Artificial Sequence
  Description of Artificial Sequence: Synthetic oligonucleotide
agacacaactacggggttggggagagc

SEQ ID NO: 419212 - DNA, 27 bp, Artificial Sequence
  Description of Artificial Sequence: Synthetic oligonucleotide
gacacaactacggggttggggagagct

SEQ ID NO: 419213 - DNA, 28 bp, Artificial Sequence
  Description of Artificial Sequence: Synthetic oligonucleotide
acacaactacggggttggggagagcttc

SEQ ID NO: 419214 - DNA, 27 bp, Artificial Sequence
  Description of Artificial Sequence: Synthetic oligonucleotide
cacaactacggggttggggagagcttc

SEQ ID NO: 419215 - DNA, 28 bp, Artificial Sequence
  Description of Artificial Sequence: Synthetic oligonucleotide
acaactacggggttggggagagcttcac

SEQ ID NO: 419216 - DNA, 27 bp, Artificial Sequence
  Description of Artificial Sequence: Synthetic oligonucleotide
caactacggggttggggagagcttcac

SEQ ID NO: 419217 - DNA, 28 bp, Artificial Sequence
  Description of Artificial Sequence: Synthetic oligonucleotide
aactacggggttggggagagcttcacag

SEQ ID NO: 419218 - DNA, 27 bp, Artificial Sequence
  Description of Artificial Sequence: Synthetic oligonucleotide
actacggggttggggagagcttcacag

SEQ ID NO: 419219 - DNA, 27 bp, Artificial Sequence
  Description of Artificial Sequence: Synthetic oligonucleotide
ctacggggttggggagagcttcacagt

SEQ ID NO: 419220 - DNA, 27 bp, Artificial Sequence
  Description of Artificial Sequence: Synthetic oligonucleotide
tacggggttggggagagcttcacagtg

SEQ ID NO: 419221 - DNA, 26 bp, Artificial Sequence
  Description of Artificial Sequence: Synthetic oligonucleotide
acggggttggggagagcttcacagtg

SEQ ID NO: 419222 - DNA, 25 bp, Artificial Sequence
  Description of Artificial Sequence: Synthetic oligonucleotide
cggggttggggagagcttcacagtg

SEQ ID NO: 419223 - DNA, 26 bp, Artificial Sequence
  Description of Artificial Sequence: Synthetic oligonucleotide
ggggttggggagagcttcacagtgca

SEQ ID NO: 419224 - DNA, 27 bp, Artificial Sequence
  Description of Artificial Sequence: Synthetic oligonucleotide
gggttggggagagcttcacagtgcaga

SEQ ID NO: 419225 - DNA, 27 bp, Artificial Sequence
  Description of Artificial Sequence: Synthetic oligonucleotide
ggttggggagagcttcacagtgcagag

SEQ ID NO: 419226 - DNA, 27 bp, Artificial Sequence
  Description of Artificial Sequence: Synthetic oligonucleotide
gttggggagagcttcacagtgcagagg

SEQ ID NO: 419227 - DNA, 27 bp, Artificial Sequence
  Description of Artificial Sequence: Synthetic oligonucleotide
ttggggagagcttcacagtgcagaggc

SEQ ID NO: 419228 - DNA, 26 bp, Artificial Sequence
  Description of Artificial Sequence: Synthetic oligonucleotide
tggggagagcttcacagtgcagaggc

SEQ ID NO: 419229 - DNA, 25 bp, Artificial Sequence
  Description of Artificial Sequence: Synthetic oligonucleotide
ggggagagcttcacagtgcagaggc

SEQ ID NO: 419230 - DNA, 26 bp, Artificial Sequence
  Description of Artificial Sequence: Synthetic oligonucleotide
gggagagcttcacagtgcagaggcga

SEQ ID NO: 419231 - DNA, 26 bp, Artificial Sequence
  Description of Artificial Sequence: Synthetic oligonucleotide
ggagagcttcacagtgcagaggcgag

SEQ ID NO: 419232 - DNA, 23 bp, Artificial Sequence
  Description of Artificial Sequence: Synthetic oligonucleotide
gggagttccgggcggtgacggaa

SEQ ID NO: 419233 - DNA, 24 bp, Artificial Sequence
  Description of Artificial Sequence: Synthetic oligonucleotide
ggagttccgggcggtgacggaact

SEQ ID NO: 419234 - DNA, 24 bp, Artificial Sequence
  Description of Artificial Sequence: Synthetic oligonucleotide
gagttccgggcggtgacggaactg

SEQ ID NO: 419235 - DNA, 24 bp, Artificial Sequence
  Description of Artificial Sequence: Synthetic oligonucleotide
agttccgggcggtgacggaactgg

SEQ ID NO: 419236 - DNA, 23 bp, Artificial Sequence
  Description of Artificial Sequence: Synthetic oligonucleotide
gttccgggcggtgacggaactgg

SEQ ID NO: 419237 - DNA, 23 bp, Artificial Sequence
  Description of Artificial Sequence: Synthetic oligonucleotide
ttccgggcggtgacggaactggg

SEQ ID NO: 419238 - DNA, 22 bp, Artificial Sequence
  Description of Artificial Sequence: Synthetic oligonucleotide
tccgggcggtgacggaactggg

SEQ ID NO: 419239 - DNA, 21 bp, Artificial Sequence
  Description of Artificial Sequence: Synthetic oligonucleotide
ccgggcggtgacggaactggg

SEQ ID NO: 419240 - DNA, 21 bp, Artificial Sequence
  Description of Artificial Sequence: Synthetic oligonucleotide
cgggcggtgacggaactgggg

SEQ ID NO: 419241 - DNA, 21 bp, Artificial Sequence
  Description of Artificial Sequence: Synthetic oligonucleotide
gggcggtgacggaactggggc

SEQ ID NO: 419242 - DNA, 21 bp, Artificial Sequence
  Description of Artificial Sequence: Synthetic oligonucleotide
ggcggtgacggaactggggcg

SEQ ID NO: 419243 - DNA, 21 bp, Artificial Sequence
  Description of Artificial Sequence: Synthetic oligonucleotide
gcggtgacggaactggggcgg

SEQ ID NO: 419244 - DNA, 21 bp, Artificial Sequence
  Description of Artificial Sequence: Synthetic oligonucleotide
cggtgacggaactggggcggc

SEQ ID NO: 419245 - DNA, 22 bp, Artificial Sequence
  Description of Artificial Sequence: Synthetic oligonucleotide
ggtgacggaactggggcggcct

SEQ ID NO: 419246 - DNA, 24 bp, Artificial Sequence
  Description of Artificial Sequence: Synthetic oligonucleotide
gtgacggaactggggcggcctgat

SEQ ID NO: 419247 - DNA, 24 bp, Artificial Sequence
  Description of Artificial Sequence: Synthetic oligonucleotide
tgacggaactggggcggcctgatg

SEQ ID NO: 419248 - DNA, 23 bp, Artificial Sequence
  Description of Artificial Sequence: Synthetic oligonucleotide
gacggaactggggcggcctgatg

SEQ ID NO: 419249 - DNA, 23 bp, Artificial Sequence
  Description of Artificial Sequence: Synthetic oligonucleotide
acggaactggggcggcctgatgc

SEQ ID NO: 419250 - DNA, 22 bp, Artificial Sequence
  Description of Artificial Sequence: Synthetic oligonucleotide
cggaactggggcggcctgatgc

SEQ ID NO: 419251 - DNA, 22 bp, Artificial Sequence
  Description of Artificial Sequence: Synthetic oligonucleotide
ggaactggggcggcctgatgcc

SEQ ID NO: 419252 - DNA, 23 bp, Artificial Sequence
  Description of Artificial Sequence: Synthetic oligonucleotide
gaactggggcggcctgatgccga

SEQ ID NO: 419253 - DNA, 25 bp, Artificial Sequence
  Description of Artificial Sequence: Synthetic oligonucleotide
aactggggcggcctgatgccgagta

SEQ ID NO: 419254 - DNA, 24 bp, Artificial Sequence
  Description of Artificial Sequence: Synthetic oligonucleotide
actggggcggcctgatgccgagta

SEQ ID NO: 419255 - DNA, 23 bp, Artificial Sequence
  Description of Artificial Sequence: Synthetic oligonucleotide
agtgacggagctggggcggccta

SEQ ID NO: 419256 - DNA, 21 bp, Artificial Sequence
  Description of Artificial Sequence: Synthetic oligonucleotide
cgggcggtgacggagctggga

SEQ ID NO: 419257 - DNA, 21 bp, Artificial Sequence
  Description of Artificial Sequence: Synthetic oligonucleotide
gggcggtgacggagctgggac

SEQ ID NO: 419258 - DNA, 21 bp, Artificial Sequence
  Description of Artificial Sequence: Synthetic oligonucleotide
ggcggtgacggagctgggacg

SEQ ID NO: 419259 - DNA, 21 bp, Artificial Sequence
  Description of Artificial Sequence: Synthetic oligonucleotide
gcggtgacggagctgggacgg

SEQ ID NO: 419260 - DNA, 21 bp, Artificial Sequence
  Description of Artificial Sequence: Synthetic oligonucleotide
cggtgacggagctgggacggc

SEQ ID NO: 419261 - DNA, 23 bp, Artificial Sequence
  Description of Artificial Sequence: Synthetic oligonucleotide
ggtgacggagctgggacggccta

SEQ ID NO: 419262 - DNA, 23 bp, Artificial Sequence
  Description of Artificial Sequence: Synthetic oligonucleotide
gtgacggagctgggacggcctag

SEQ ID NO: 419263 - DNA, 23 bp, Artificial Sequence
  Description of Artificial Sequence: Synthetic oligonucleotide
tgacggagctgggacggcctagc

SEQ ID NO: 419264 - DNA, 22 bp, Artificial Sequence
  Description of Artificial Sequence: Synthetic oligonucleotide
gacggagctgggacggcctagc

SEQ ID NO: 419265 - DNA, 22 bp, Artificial Sequence
  Description of Artificial Sequence: Synthetic oligonucleotide
acggagctgggacggcctagcg

SEQ ID NO: 419266 - DNA, 21 bp, Artificial Sequence
  Description of Artificial Sequence: Synthetic oligonucleotide
cggagctgggacggcctagcg

SEQ ID NO: 419267 - DNA, 21 bp, Artificial Sequence
  Description of Artificial Sequence: Synthetic oligonucleotide
ggagctgggacggcctagcgc

SEQ ID NO: 419268 - DNA, 21 bp, Artificial Sequence
  Description of Artificial Sequence: Synthetic oligonucleotide
gagctgggacggcctagcgcc

SEQ ID NO: 419269 - DNA, 22 bp, Artificial Sequence
  Description of Artificial Sequence: Synthetic oligonucleotide
agctgggacggcctagcgccga

SEQ ID NO: 419270 - DNA, 21 bp, Artificial Sequence
  Description of Artificial Sequence: Synthetic oligonucleotide
gctgggacggcctagcgccga

SEQ ID NO: 419271 - DNA, 23 bp, Artificial Sequence
  Description of Artificial Sequence: Synthetic oligonucleotide
ctgggacggcctagcgccgagta

SEQ ID NO: 419272 - DNA, 24 bp, Artificial Sequence
  Description of Artificial Sequence: Synthetic oligonucleotide
tgggacggcctagcgccgagtact

SEQ ID NO: 419273 - DNA, 23 bp, Artificial Sequence
  Description of Artificial Sequence: Synthetic oligonucleotide
gggacggcctagcgccgagtact

SEQ ID NO: 419274 - DNA, 23 bp, Artificial Sequence
  Description of Artificial Sequence: Synthetic oligonucleotide
ggacggcctagcgccgagtactg

SEQ ID NO: 419275 - DNA, 25 bp, Artificial Sequence
  Description of Artificial Sequence: Synthetic oligonucleotide
gacggcctagcgccgagtactggaa

SEQ ID NO: 419276 - DNA, 26 bp, Artificial Sequence
  Description of Artificial Sequence: Synthetic oligonucleotide
acggcctagcgccgagtactggaaca

SEQ ID NO: 419277 - DNA, 32 bp, Artificial Sequence; identical to SEQ ID NO: 71427
  Description of Artificial Sequence: Synthetic oligonucleotide

SEQ ID NO: 419278 - DNA, 32 bp, Artificial Sequence; identical to SEQ ID NO: 71428
  Description of Artificial Sequence: Synthetic oligonucleotide

SEQ ID NO: 419279 - DNA, 31 bp, Artificial Sequence; identical to SEQ ID NO: 71429
  Description of Artificial Sequence: Synthetic oligonucleotide

SEQ ID NO: 419280 - DNA, 35 bp, Artificial Sequence; identical to SEQ ID NO: 71430
  Description of Artificial Sequence: Synthetic oligonucleotide

SEQ ID NO: 419281 - DNA, 37 bp, Artificial Sequence; identical to SEQ ID NO: 71431
  Description of Artificial Sequence: Synthetic oligonucleotide

SEQ ID NO: 419282 - DNA, 36 bp, Artificial Sequence; identical to SEQ ID NO: 71432
  Description of Artificial Sequence: Synthetic oligonucleotide

SEQ ID NO: 419283 - DNA, 35 bp, Artificial Sequence; identical to SEQ ID NO: 71433
  Description of Artificial Sequence: Synthetic oligonucleotide

SEQ ID NO: 419284 - DNA, 34 bp, Artificial Sequence; identical to SEQ ID NO: 71434
  Description of Artificial Sequence: Synthetic oligonucleotide

SEQ ID NO: 419285 - DNA, 37 bp, Artificial Sequence; identical to SEQ ID NO: 71435
  Description of Artificial Sequence: Synthetic oligonucleotide

SEQ ID NO: 419286 - DNA, 36 bp, Artificial Sequence; identical to SEQ ID NO: 71436
  Description of Artificial Sequence: Synthetic oligonucleotide

SEQ ID NO: 419287 - DNA, 35 bp, Artificial Sequence; identical to SEQ ID NO: 71437
  Description of Artificial Sequence: Synthetic oligonucleotide

SEQ ID NO: 419288 - DNA, 35 bp, Artificial Sequence; identical to SEQ ID NO: 71438
  Description of Artificial Sequence: Synthetic oligonucleotide

SEQ ID NO: 419289 - DNA, 35 bp, Artificial Sequence; identical to SEQ ID NO: 71439
  Description of Artificial Sequence: Synthetic oligonucleotide

SEQ ID NO: 419290 - DNA, 34 bp, Artificial Sequence; identical to SEQ ID NO: 71440
  Description of Artificial Sequence: Synthetic oligonucleotide

SEQ ID NO: 419291 - DNA, 35 bp, Artificial Sequence; identical to SEQ ID NO: 71441
  Description of Artificial Sequence: Synthetic oligonucleotide

SEQ ID NO: 419292 - DNA, 34 bp, Artificial Sequence; identical to SEQ ID NO: 71442
  Description of Artificial Sequence: Synthetic oligonucleotide

SEQ ID NO: 419293 - DNA, 33 bp, Artificial Sequence; identical to SEQ ID NO: 71443
  Description of Artificial Sequence: Synthetic oligonucleotide

SEQ ID NO: 419294 - DNA, 33 bp, Artificial Sequence; identical to SEQ ID NO: 71444
  Description of Artificial Sequence: Synthetic oligonucleotide

SEQ ID NO: 419295 - DNA, 32 bp, Artificial Sequence; identical to SEQ ID NO: 71445
  Description of Artificial Sequence: Synthetic oligonucleotide

SEQ ID NO: 419296 - DNA, 32 bp, Artificial Sequence; identical to SEQ ID NO: 71446
  Description of Artificial Sequence: Synthetic oligonucleotide

SEQ ID NO: 419297 - DNA, 31 bp, Artificial Sequence; identical to SEQ ID NO: 71447
  Description of Artificial Sequence: Synthetic oligonucleotide

SEQ ID NO: 419298 - DNA, 30 bp, Artificial Sequence; identical to SEQ ID NO: 71448
  Description of Artificial Sequence: Synthetic oligonucleotide

SEQ ID NO: 419299 - DNA, 31 bp, Artificial Sequence; identical to SEQ ID NO: 71449
  Description of Artificial Sequence: Synthetic oligonucleotide

SEQ ID NO: 419300 - DNA, 31 bp, Artificial Sequence; identical to SEQ ID NO: 71450
  Description of Artificial Sequence: Synthetic oligonucleotide

SEQ ID NO: 419301 - DNA, 30 bp, Artificial Sequence; identical to SEQ ID NO: 71451
  Description of Artificial Sequence: Synthetic oligonucleotide

SEQ ID NO: 419302 - DNA, 30 bp, Artificial Sequence; identical to SEQ ID NO: 71452
  Description of Artificial Sequence: Synthetic oligonucleotide

SEQ ID NO: 419303 - DNA, 29 bp, Artificial Sequence
  Description of Artificial Sequence: Synthetic oligonucleotide
gagtgccatttcttcaatgggacggagcg

SEQ ID NO: 419304 - DNA, 29 bp, Artificial Sequence
  Description of Artificial Sequence: Synthetic oligonucleotide
agtgccatttcttcaatgggacggagcgg

SEQ ID NO: 419305 - DNA, 28 bp, Artificial Sequence
  Description of Artificial Sequence: Synthetic oligonucleotide
gtgccatttcttcaatgggacggagcgg

SEQ ID NO: 419306 - DNA, 28 bp, Artificial Sequence
  Description of Artificial Sequence: Synthetic oligonucleotide
tgccatttcttcaatgggacggagcggg

SEQ ID NO: 419307 - DNA, 27 bp, Artificial Sequence
  Description of Artificial Sequence: Synthetic oligonucleotide
gccatttcttcaatgggacggagcggg

SEQ ID NO: 419308 - DNA, 28 bp, Artificial Sequence
  Description of Artificial Sequence: Synthetic oligonucleotide
ccatttcttcaatgggacggagcgggtg

SEQ ID NO: 419309 - DNA, 25 bp, Artificial Sequence
  Description of Artificial Sequence: Synthetic oligonucleotide
gtgagagcttcacagtgcagcggcg

SEQ ID NO: 419310 - DNA, 25 bp, Artificial Sequence
  Description of Artificial Sequence: Synthetic oligonucleotide
gagcgggtgcggttcctggacagat

SEQ ID NO: 419311 - DNA, 25 bp, Artificial Sequence
  Description of Artificial Sequence: Synthetic oligonucleotide
agcgggtgcggttcctggacagatc

SEQ ID NO: 419312 - DNA, 24 bp, Artificial Sequence
  Description of Artificial Sequence: Synthetic oligonucleotide
gcgggtgcggttcctggacagatc

SEQ ID NO: 419313 - DNA, 26 bp, Artificial Sequence
  Description of Artificial Sequence: Synthetic oligonucleotide
cgggtgcggttcctggacagatcctt

SEQ ID NO: 419314 - DNA, 27 bp, Artificial Sequence
  Description of Artificial Sequence: Synthetic oligonucleotide
gggtgcggttcctggacagatccttct

SEQ ID NO: 419315 - DNA, 31 bp, Artificial Sequence; identical to SEQ ID NO: 71465
  Description of Artificial Sequence: Synthetic oligonucleotide

SEQ ID NO: 419316 - DNA, 31 bp, Artificial Sequence; identical to SEQ ID NO: 71466
  Description of Artificial Sequence: Synthetic oligonucleotide

SEQ ID NO: 419317 - DNA, 33 bp, Artificial Sequence; identical to SEQ ID NO: 71467
  Description of Artificial Sequence: Synthetic oligonucleotide

SEQ ID NO: 419318 - DNA, 32 bp, Artificial Sequence; identical to SEQ ID NO: 71468
  Description of Artificial Sequence: Synthetic oligonucleotide

SEQ ID NO: 419319 - DNA, 33 bp, Artificial Sequence; identical to SEQ ID NO: 71469
  Description of Artificial Sequence: Synthetic oligonucleotide

SEQ ID NO: 419320 - DNA, 33 bp, Artificial Sequence; identical to SEQ ID NO: 71470
  Description of Artificial Sequence: Synthetic oligonucleotide

SEQ ID NO: 419321 - DNA, 34 bp, Artificial Sequence; identical to SEQ ID NO: 71471
  Description of Artificial Sequence: Synthetic oligonucleotide

SEQ ID NO: 419322 - DNA, 36 bp, Artificial Sequence; identical to SEQ ID NO: 71472
  Description of Artificial Sequence: Synthetic oligonucleotide

SEQ ID NO: 419323 - DNA, 35 bp, Artificial Sequence; identical to SEQ ID NO: 71473
  Description of Artificial Sequence: Synthetic oligonucleotide

SEQ ID NO: 419324 - DNA, 34 bp, Artificial Sequence; identical to SEQ ID NO: 71474
  Description of Artificial Sequence: Synthetic oligonucleotide

SEQ ID NO: 419325 - DNA, 34 bp, Artificial Sequence; identical to SEQ ID NO: 71475
  Description of Artificial Sequence: Synthetic oligonucleotide

SEQ ID NO: 419326 - DNA, 35 bp, Artificial Sequence; identical to SEQ ID NO: 71476
  Description of Artificial Sequence: Synthetic oligonucleotide

SEQ ID NO: 419327 - DNA, 34 bp, Artificial Sequence; identical to SEQ ID NO: 71477
  Description of Artificial Sequence: Synthetic oligonucleotide

SEQ ID NO: 419328 - DNA, 34 bp, Artificial Sequence; identical to SEQ ID NO: 71478
  Description of Artificial Sequence: Synthetic oligonucleotide

SEQ ID NO: 419329 - DNA, 34 bp, Artificial Sequence; identical to SEQ ID NO: 71479
  Description of Artificial Sequence: Synthetic oligonucleotide

SEQ ID NO: 419330 - DNA, 33 bp, Artificial Sequence; identical to SEQ ID NO: 71480
  Description of Artificial Sequence: Synthetic oligonucleotide

SEQ ID NO: 419331 - DNA, 33 bp, Artificial Sequence; identical to SEQ ID NO: 71481
  Description of Artificial Sequence: Synthetic oligonucleotide

SEQ ID NO: 419332 - DNA, 32 bp, Artificial Sequence; identical to SEQ ID NO: 71482
  Description of Artificial Sequence: Synthetic oligonucleotide

SEQ ID NO: 419333 - DNA, 34 bp, Artificial Sequence; identical to SEQ ID NO: 71483
  Description of Artificial Sequence: Synthetic oligonucleotide

SEQ ID NO: 419334 - DNA, 33 bp, Artificial Sequence; identical to SEQ ID NO: 71484
  Description of Artificial Sequence: Synthetic oligonucleotide

SEQ ID NO: 419335 - DNA, 32 bp, Artificial Sequence; identical to SEQ ID NO: 71485
  Description of Artificial Sequence: Synthetic oligonucleotide

SEQ ID NO: 419336 - DNA, 25 bp, Artificial Sequence
  Description of Artificial Sequence: Synthetic oligonucleotide
ttcaatgggacggagcgggtgcggt

SEQ ID NO: 419337 - DNA, 24 bp, Artificial Sequence
  Description of Artificial Sequence: Synthetic oligonucleotide
tcaatgggacggagcgggtgcggt

SEQ ID NO: 419338 - DNA, 23 bp, Artificial Sequence
  Description of Artificial Sequence: Synthetic oligonucleotide
caatgggacggagcgggtgcggt

SEQ ID NO: 419339 - DNA, 23 bp, Artificial Sequence
  Description of Artificial Sequence: Synthetic oligonucleotide
aatgggacggagcgggtgcggtc

SEQ ID NO: 419340 - DNA, 22 bp, Artificial Sequence
  Description of Artificial Sequence: Synthetic oligonucleotide
atgggacggagcgggtgcggtc

SEQ ID NO: 419341 - DNA, 21 bp, Artificial Sequence
  Description of Artificial Sequence: Synthetic oligonucleotide
tgggacggagcgggtgcggtc

SEQ ID NO: 419342 - DNA, 20 bp, Artificial Sequence
  Description of Artificial Sequence: Synthetic oligonucleotide
gggacggagcgggtgcggtc

SEQ ID NO: 419343 - DNA, 20 bp, Artificial Sequence
  Description of Artificial Sequence: Synthetic oligonucleotide
ggacggagcgggtgcggtcc

SEQ ID NO: 419344 - DNA, 21 bp, Artificial Sequence
  Description of Artificial Sequence: Synthetic oligonucleotide
gacggagcgggtgcggtccct

SEQ ID NO: 419345 - DNA, 21 bp, Artificial Sequence
  Description of Artificial Sequence: Synthetic oligonucleotide
acggagcgggtgcggtccctg

SEQ ID NO: 419346 - DNA, 20 bp, Artificial Sequence
  Description of Artificial Sequence: Synthetic oligonucleotide
cggagcgggtgcggtccctg

SEQ ID NO: 419347 - DNA, 21 bp, Artificial Sequence
  Description of Artificial Sequence: Synthetic oligonucleotide
ggagcgggtgcggtccctgga

SEQ ID NO: 419348 - DNA, 22 bp, Artificial Sequence
  Description of Artificial Sequence: Synthetic oligonucleotide
gagcgggtgcggtccctggaca

SEQ ID NO: 419349 - DNA, 25 bp, Artificial Sequence
  Description of Artificial Sequence: Synthetic oligonucleotide
agcgggtgcggtccctggacagata

SEQ ID NO: 419350 - DNA, 24 bp, Artificial Sequence
  Description of Artificial Sequence: Synthetic oligonucleotide
gcgggtgcggtccctggacagata

SEQ ID NO: 419351 - DNA, 26 bp, Artificial Sequence
  Description of Artificial Sequence: Synthetic oligonucleotide
cgggtgcggtccctggacagatactt

SEQ ID NO: 419352 - DNA, 26 bp, Artificial Sequence
  Description of Artificial Sequence: Synthetic oligonucleotide
gggtgcggtccctggacagatacttc

SEQ ID NO: 419353 - DNA, 27 bp, Artificial Sequence
  Description of Artificial Sequence: Synthetic oligonucleotide
ggtgcggtccctggacagatacttcca

SEQ ID NO: 419354 - DNA, 30 bp, Artificial Sequence
  Description of Artificial Sequence: Synthetic oligonucleotide
gtgcggtccctggacagatacttccataac

SEQ ID NO: 419355 - DNA, 30 bp, Artificial Sequence
  Description of Artificial Sequence: Synthetic oligonucleotide
tgcggtccctggacagatacttccataacc

SEQ ID NO: 419356 - DNA, 29 bp, Artificial Sequence
  Description of Artificial Sequence: Synthetic oligonucleotide
gcggtccctggacagatacttccataacc

SEQ ID NO: 419357 - DNA, 30 bp, Artificial Sequence
  Description of Artificial Sequence: Synthetic oligonucleotide
cggtccctggacagatacttccataaccag

SEQ ID NO: 419358 - DNA, 30 bp, Artificial Sequence
  Description of Artificial Sequence: Synthetic oligonucleotide
ggtccctggacagatacttccataaccagg

SEQ ID NO: 419359 - DNA, 31 bp, Artificial Sequence
  Description of Artificial Sequence: Synthetic oligonucleotide
gtccctggacagatacttccataaccaggag

SEQ ID NO: 419360 - DNA, 31 bp, Artificial Sequence
  Description of Artificial Sequence: Synthetic oligonucleotide
tccctggacagatacttccataaccaggagg

SEQ ID NO: 419361 - DNA, 30 bp, Artificial Sequence
  Description of Artificial Sequence: Synthetic oligonucleotide
ccctggacagatacttccataaccaggagg

SEQ ID NO: 419362 - DNA, 38 bp, Artificial Sequence
  Description of Artificial Sequence: Synthetic oligonucleotide
cacgtttcttggagtactctatgtctgagtgtcatttc

SEQ ID NO: 419363 - DNA, 40 bp, Artificial Sequence
  Description of Artificial Sequence: Synthetic oligonucleotide
acgtttcttggagtactctatgtctgagtgtcatttcttc

SEQ ID NO: 419364 - DNA, 39 bp, Artificial Sequence
  Description of Artificial Sequence: Synthetic oligonucleotide
cgtttcttggagtactctatgtctgagtgtcatttcttc

SEQ ID NO: 419365 - DNA, 42 bp, Artificial Sequence
  Description of Artificial Sequence: Synthetic oligonucleotide
gtttcttggagtactctatgtctgagtgtcatttcttcaatg

SEQ ID NO: 419366 - DNA, 42 bp, Artificial Sequence
  Description of Artificial Sequence: Synthetic oligonucleotide
tttcttggagtactctatgtctgagtgtcatttcttcaatgg

SEQ ID NO: 419367 - DNA, 41 bp, Artificial Sequence
  Description of Artificial Sequence: Synthetic oligonucleotide
ttcttggagtactctatgtctgagtgtcatttcttcaatgg

SEQ ID NO: 419368 - DNA, 40 bp, Artificial Sequence
  Description of Artificial Sequence: Synthetic oligonucleotide
tcttggagtactctatgtctgagtgtcatttcttcaatgg

SEQ ID NO: 419369 - DNA, 39 bp, Artificial Sequence
  Description of Artificial Sequence: Synthetic oligonucleotide
cttggagtactctatgtctgagtgtcatttcttcaatgg

SEQ ID NO: 419370 - DNA, 39 bp, Artificial Sequence
  Description of Artificial Sequence: Synthetic oligonucleotide
ttggagtactctatgtctgagtgtcatttcttcaatggg

SEQ ID NO: 419371 - DNA, 38 bp, Artificial Sequence
  Description of Artificial Sequence: Synthetic oligonucleotide
tggagtactctatgtctgagtgtcatttcttcaatggg

SEQ ID NO: 419372 - DNA, 37 bp, Artificial Sequence
  Description of Artificial Sequence: Synthetic oligonucleotide
ggagtactctatgtctgagtgtcatttcttcaatggg

SEQ ID NO: 419373 - DNA, 38 bp, Artificial Sequence
  Description of Artificial Sequence: Synthetic oligonucleotide
gagtactctatgtctgagtgtcatttcttcaatgggac

SEQ ID NO: 419374 - DNA, 38 bp, Artificial Sequence
  Description of Artificial Sequence: Synthetic oligonucleotide
agtactctatgtctgagtgtcatttcttcaatgggacg

SEQ ID NO: 419375 - DNA, 37 bp, Artificial Sequence
  Description of Artificial Sequence: Synthetic oligonucleotide
gtactctatgtctgagtgtcatttcttcaatgggacg

SEQ ID NO: 419376 - DNA, 37 bp, Artificial Sequence
  Description of Artificial Sequence: Synthetic oligonucleotide
tactctatgtctgagtgtcatttcttcaatgggacgg

SEQ ID NO: 419377 - DNA, 36 bp, Artificial Sequence
  Description of Artificial Sequence: Synthetic oligonucleotide
actctatgtctgagtgtcatttcttcaatgggacgg

SEQ ID NO: 419378 - DNA, 35 bp, Artificial Sequence
  Description of Artificial Sequence: Synthetic oligonucleotide
ctctatgtctgagtgtcatttcttcaatgggacgg

SEQ ID NO: 419379 - DNA, 36 bp, Artificial Sequence
  Description of Artificial Sequence: Synthetic oligonucleotide
tctatgtctgagtgtcatttcttcaatgggacggag

SEQ ID NO: 419380 - DNA, 35 bp, Artificial Sequence
  Description of Artificial Sequence: Synthetic oligonucleotide
ctatgtctgagtgtcatttcttcaatgggacggag

SEQ ID NO: 419381 - DNA, 35 bp, Artificial Sequence
  Description of Artificial Sequence: Synthetic oligonucleotide
tatgtctgagtgtcatttcttcaatgggacggagc

SEQ ID NO: 419382 - DNA, 34 bp, Artificial Sequence
  Description of Artificial Sequence: Synthetic oligonucleotide
atgtctgagtgtcatttcttcaatgggacggagc

SEQ ID NO: 419383 - DNA, 33 bp, Artificial Sequence
  Description of Artificial Sequence: Synthetic oligonucleotide
tgtctgagtgtcatttcttcaatgggacggagc

SEQ ID NO: 419384 - DNA, 28 bp, Artificial Sequence
  Description of Artificial Sequence: Synthetic oligonucleotide
ggttgtggagagcttcacagtgcagcag

SEQ ID NO: 419385 - DNA, 28 bp, Artificial Sequence
  Description of Artificial Sequence: Synthetic oligonucleotide
gttgtggagagcttcacagtgcagcagc

SEQ ID NO: 419386 - DNA, 28 bp, Artificial Sequence
  Description of Artificial Sequence: Synthetic oligonucleotide
ttgtggagagcttcacagtgcagcagcg

SEQ ID NO: 419387 - DNA, 27 bp, Artificial Sequence
  Description of Artificial Sequence: Synthetic oligonucleotide
tgtggagagcttcacagtgcagcagcg

SEQ ID NO: 419388 - DNA, 27 bp, Artificial Sequence
  Description of Artificial Sequence: Synthetic oligonucleotide
gtggagagcttcacagtgcagcagcga

SEQ ID NO: 419389 - DNA, 27 bp, Artificial Sequence
  Description of Artificial Sequence: Synthetic oligonucleotide
tggagagcttcacagtgcagcagcgag

SEQ ID NO: 419390 - DNA, 30 bp, Artificial Sequence
  Description of Artificial Sequence: Synthetic oligonucleotide
tactgcagacacaactacggggttggtgac

SEQ ID NO: 419391 - DNA, 29 bp, Artificial Sequence
  Description of Artificial Sequence: Synthetic oligonucleotide
actgcagacacaactacggggttggtgac

SEQ ID NO: 419392 - DNA, 28 bp, Artificial Sequence
  Description of Artificial Sequence: Synthetic oligonucleotide
ctgcagacacaactacggggttggtgac

SEQ ID NO: 419393 - DNA, 29 bp, Artificial Sequence
  Description of Artificial Sequence: Synthetic oligonucleotide
tgcagacacaactacggggttggtgacag

SEQ ID NO: 419394 - DNA, 28 bp, Artificial Sequence
  Description of Artificial Sequence: Synthetic oligonucleotide
gcagacacaactacggggttggtgacag

SEQ ID NO: 419395 - DNA, 28 bp, Artificial Sequence
  Description of Artificial Sequence: Synthetic oligonucleotide
cagacacaactacggggttggtgacagc

SEQ ID NO: 419396 - DNA, 30 bp, Artificial Sequence
  Description of Artificial Sequence: Synthetic oligonucleotide
agacacaactacggggttggtgacagcttc

SEQ ID NO: 419397 - DNA, 29 bp, Artificial Sequence
  Description of Artificial Sequence: Synthetic oligonucleotide
gacacaactacggggttggtgacagcttc

SEQ ID NO: 419398 - DNA, 30 bp, Artificial Sequence
  Description of Artificial Sequence: Synthetic oligonucleotide
acacaactacggggttggtgacagcttcac

SEQ ID NO: 419399 - DNA, 29 bp, Artificial Sequence
  Description of Artificial Sequence: Synthetic oligonucleotide
cacaactacggggttggtgacagcttcac

SEQ ID NO: 419400 - DNA, 30 bp, Artificial Sequence
  Description of Artificial Sequence: Synthetic oligonucleotide
acaactacggggttggtgacagcttcacag

SEQ ID NO: 419401 - DNA, 29 bp, Artificial Sequence
  Description of Artificial Sequence: Synthetic oligonucleotide
caactacggggttggtgacagcttcacag

SEQ ID NO: 419402 - DNA, 30 bp, Artificial Sequence
  Description of Artificial Sequence: Synthetic oligonucleotide
aactacggggttggtgacagcttcacagtg

SEQ ID NO: 419403 - DNA, 29 bp, Artificial Sequence
  Description of Artificial Sequence: Synthetic oligonucleotide
actacggggttggtgacagcttcacagtg

SEQ ID NO: 419404 - DNA, 28 bp, Artificial Sequence
  Description of Artificial Sequence: Synthetic oligonucleotide
ctacggggttggtgacagcttcacagtg

SEQ ID NO: 419405 - DNA, 28 bp, Artificial Sequence
  Description of Artificial Sequence: Synthetic oligonucleotide
tacggggttggtgacagcttcacagtgc

SEQ ID NO: 419406 - DNA, 27 bp, Artificial Sequence
  Description of Artificial Sequence: Synthetic oligonucleotide
acggggttggtgacagcttcacagtgc

SEQ ID NO: 419407 - DNA, 27 bp, Artificial Sequence
  Description of Artificial Sequence: Synthetic oligonucleotide
cggggttggtgacagcttcacagtgca

SEQ ID NO: 419408 - DNA, 27 bp, Artificial Sequence
  Description of Artificial Sequence: Synthetic oligonucleotide
ggggttggtgacagcttcacagtgcag

SEQ ID NO: 419409 - DNA, 27 bp, Artificial Sequence
  Description of Artificial Sequence: Synthetic oligonucleotide
gggttggtgacagcttcacagtgcagc

SEQ ID NO: 419410 - DNA, 27 bp, Artificial Sequence
  Description of Artificial Sequence: Synthetic oligonucleotide
ggttggtgacagcttcacagtgcagcg

SEQ ID NO: 419411 - DNA, 27 bp, Artificial Sequence
  Description of Artificial Sequence: Synthetic oligonucleotide
gttggtgacagcttcacagtgcagcgg

SEQ ID NO: 419412 - DNA, 27 bp, Artificial Sequence
  Description of Artificial Sequence: Synthetic oligonucleotide
ttggtgacagcttcacagtgcagcggc

SEQ ID NO: 419413 - DNA, 26 bp, Artificial Sequence
  Description of Artificial Sequence: Synthetic oligonucleotide
tggtgacagcttcacagtgcagcggc

SEQ ID NO: 419414 - DNA, 25 bp, Artificial Sequence
  Description of Artificial Sequence: Synthetic oligonucleotide
ggtgacagcttcacagtgcagcggc

SEQ ID NO: 419415 - DNA, 26 bp, Artificial Sequence
  Description of Artificial Sequence: Synthetic oligonucleotide
gtgacagcttcacagtgcagcggcga

SEQ ID NO: 419416 - DNA, 26 bp, Artificial Sequence
  Description of Artificial Sequence: Synthetic oligonucleotide
tgacagcttcacagtgcagcggcgag

SEQ ID NO: 419417 - DNA, 29 bp, Artificial Sequence
  Description of Artificial Sequence: Synthetic oligonucleotide
agccagaaggacatcctggaagacgagtg

SEQ ID NO: 419418 - DNA, 28 bp, Artificial Sequence
  Description of Artificial Sequence: Synthetic oligonucleotide
gccagaaggacatcctggaagacgagtg

SEQ ID NO: 419419 - DNA, 28 bp, Artificial Sequence
  Description of Artificial Sequence: Synthetic oligonucleotide
ccagaaggacatcctggaagacgagtgg

SEQ ID NO: 419420 - DNA, 28 bp, Artificial Sequence
  Description of Artificial Sequence: Synthetic oligonucleotide
cagaaggacatcctggaagacgagtggg

SEQ ID NO: 419421 - DNA, 28 bp, Artificial Sequence
  Description of Artificial Sequence: Synthetic oligonucleotide
agaaggacatcctggaagacgagtgggc

SEQ ID NO: 419422 - DNA, 27 bp, Artificial Sequence
  Description of Artificial Sequence: Synthetic oligonucleotide
gaaggacatcctggaagacgagtgggc

SEQ ID NO: 419423 - DNA, 27 bp, Artificial Sequence
  Description of Artificial Sequence: Synthetic oligonucleotide
aaggacatcctggaagacgagtgggcc

SEQ ID NO: 419424 - DNA, 26 bp, Artificial Sequence
  Description of Artificial Sequence: Synthetic oligonucleotide
aggacatcctggaagacgagtgggcc

SEQ ID NO: 419425 - DNA, 25 bp, Artificial Sequence
  Description of Artificial Sequence: Synthetic oligonucleotide
ggacatcctggaagacgagtgggcc

SEQ ID NO: 419426 - DNA, 25 bp, Artificial Sequence
  Description of Artificial Sequence: Synthetic oligonucleotide
gacatcctggaagacgagtgggccg

SEQ ID NO: 419427 - DNA, 25 bp, Artificial Sequence
  Description of Artificial Sequence: Synthetic oligonucleotide
acatcctggaagacgagtgggccgc

SEQ ID NO: 419428 - DNA, 24 bp, Artificial Sequence
  Description of Artificial Sequence: Synthetic oligonucleotide
catcctggaagacgagtgggccgc

SEQ ID NO: 419429 - DNA, 24 bp, Artificial Sequence
  Description of Artificial Sequence: Synthetic oligonucleotide
atcctggaagacgagtgggccgcg

SEQ ID NO: 419430 - DNA, 23 bp, Artificial Sequence
  Description of Artificial Sequence: Synthetic oligonucleotide
tcctggaagacgagtgggccgcg

SEQ ID NO: 419431 - DNA, 22 bp, Artificial Sequence
  Description of Artificial Sequence: Synthetic oligonucleotide
cctggaagacgagtgggccgcg

SEQ ID NO: 419432 - DNA, 23 bp, Artificial Sequence
  Description of Artificial Sequence: Synthetic oligonucleotide
ctggaagacgagtgggccgcggt

SEQ ID NO: 419433 - DNA, 23 bp, Artificial Sequence
  Description of Artificial Sequence: Synthetic oligonucleotide
tggaagacgagtgggccgcggtg

SEQ ID NO: 419434 - DNA, 22 bp, Artificial Sequence
  Description of Artificial Sequence: Synthetic oligonucleotide
ggaagacgagtgggccgcggtg

SEQ ID NO: 419435 - DNA, 23 bp, Artificial Sequence
  Description of Artificial Sequence: Synthetic oligonucleotide
gaagacgagtgggccgcggtgga

SEQ ID NO: 419436 - DNA, 24 bp, Artificial Sequence
  Description of Artificial Sequence: Synthetic oligonucleotide
aagacgagtgggccgcggtggaca

SEQ ID NO: 419437 - DNA, 23 bp, Artificial Sequence
  Description of Artificial Sequence: Synthetic oligonucleotide
agacgagtgggccgcggtggaca

SEQ ID NO: 419438 - DNA, 22 bp, Artificial Sequence
  Description of Artificial Sequence: Synthetic oligonucleotide
gacgagtgggccgcggtggaca

SEQ ID NO: 419439 - DNA, 22 bp, Artificial Sequence
  Description of Artificial Sequence: Synthetic oligonucleotide
acgagtgggccgcggtggacac

SEQ ID NO: 419440 - DNA, 21 bp, Artificial Sequence
  Description of Artificial Sequence: Synthetic oligonucleotide
cgagtgggccgcggtggacac

SEQ ID NO: 419441 - DNA, 23 bp, Artificial Sequence
  Description of Artificial Sequence: Synthetic oligonucleotide
gagtgggccgcggtggacaccta

SEQ ID NO: 419442 - DNA, 24 bp, Artificial Sequence
  Description of Artificial Sequence: Synthetic oligonucleotide
agtgggccgcggtggacacctact

SEQ ID NO: 419443 - DNA, 23 bp, Artificial Sequence
  Description of Artificial Sequence: Synthetic oligonucleotide
gtgggccgcggtggacacctact

SEQ ID NO: 419444 - DNA, 23 bp, Artificial Sequence
  Description of Artificial Sequence: Synthetic oligonucleotide
tgggccgcggtggacacctactg

SEQ ID NO: 419445 - DNA, 38 bp, Artificial Sequence
  Description of Artificial Sequence: Synthetic oligonucleotide
catgtttcttggagtactctacgtctgagtgtcatttc

SEQ ID NO: 419446 - DNA, 40 bp, Artificial Sequence
  Description of Artificial Sequence: Synthetic oligonucleotide
atgtttcttggagtactctacgtctgagtgtcatttcttc

SEQ ID NO: 419447 - DNA, 39 bp, Artificial Sequence
  Description of Artificial Sequence: Synthetic oligonucleotide
tgtttcttggagtactctacgtctgagtgtcatttcttc

SEQ ID NO: 419448 - DNA, 28 bp, Artificial Sequence
  Description of Artificial Sequence: Synthetic oligonucleotide
tggaacagccagaaggacgtcctggaag

SEQ ID NO: 419449 - DNA, 27 bp, Artificial Sequence
  Description of Artificial Sequence: Synthetic oligonucleotide
ggaacagccagaaggacgtcctggaag

SEQ ID NO: 419450 - DNA, 28 bp, Artificial Sequence
  Description of Artificial Sequence: Synthetic oligonucleotide
gaacagccagaaggacgtcctggaagac

SEQ ID NO: 419451 - DNA, 28 bp, Artificial Sequence
  Description of Artificial Sequence: Synthetic oligonucleotide
aacagccagaaggacgtcctggaagacg

SEQ ID NO: 419452 - DNA, 27 bp, Artificial Sequence
  Description of Artificial Sequence: Synthetic oligonucleotide
acagccagaaggacgtcctggaagacg

SEQ ID NO: 419453 - DNA, 27 bp, Artificial Sequence
  Description of Artificial Sequence: Synthetic oligonucleotide
cagccagaaggacgtcctggaagacga

SEQ ID NO: 419454 - DNA, 27 bp, Artificial Sequence
  Description of Artificial Sequence: Synthetic oligonucleotide
agccagaaggacgtcctggaagacgag

SEQ ID NO: 419455 - DNA, 26 bp, Artificial Sequence
  Description of Artificial Sequence: Synthetic oligonucleotide
gccagaaggacgtcctggaagacgag

SEQ ID NO: 419456 - DNA, 26 bp, Artificial Sequence
  Description of Artificial Sequence: Synthetic oligonucleotide
ccagaaggacgtcctggaagacgagc

SEQ ID NO: 419457 - DNA, 26 bp, Artificial Sequence
  Description of Artificial Sequence: Synthetic oligonucleotide
cagaaggacgtcctggaagacgagcg

SEQ ID NO: 419458 - DNA, 26 bp, Artificial Sequence
  Description of Artificial Sequence: Synthetic oligonucleotide
agaaggacgtcctggaagacgagcgg

SEQ ID NO: 419459 - DNA, 25 bp, Artificial Sequence
  Description of Artificial Sequence: Synthetic oligonucleotide
gaaggacgtcctggaagacgagcgg

SEQ ID NO: 419460 - DNA, 25 bp, Artificial Sequence
  Description of Artificial Sequence: Synthetic oligonucleotide
aaggacgtcctggaagacgagcggg

SEQ ID NO: 419461 - DNA, 24 bp, Artificial Sequence
  Description of Artificial Sequence: Synthetic oligonucleotide
aggacgtcctggaagacgagcggg

SEQ ID NO: 419462 - DNA, 23 bp, Artificial Sequence
  Description of Artificial Sequence: Synthetic oligonucleotide
ggacgtcctggaagacgagcggg

SEQ ID NO: 419463 - DNA, 23 bp, Artificial Sequence
  Description of Artificial Sequence: Synthetic oligonucleotide
gacgtcctggaagacgagcgggc

SEQ ID NO: 419464 - DNA, 23 bp, Artificial Sequence
  Description of Artificial Sequence: Synthetic oligonucleotide
acgtcctggaagacgagcgggcc

SEQ ID NO: 419465 - DNA, 22 bp, Artificial Sequence
  Description of Artificial Sequence: Synthetic oligonucleotide
cgtcctggaagacgagcgggcc

SEQ ID NO: 419466 - DNA, 22 bp, Artificial Sequence
  Description of Artificial Sequence: Synthetic oligonucleotide
gtcctggaagacgagcgggccg

SEQ ID NO: 419467 - DNA, 32 bp, Artificial Sequence
  Description of Artificial Sequence: Synthetic oligonucleotide
tatccaggcagcattgaagtcaggtggttctg

SEQ ID NO: 419468 - DNA, 31 bp, Artificial Sequence
  Description of Artificial Sequence: Synthetic oligonucleotide
atccaggcagcattgaagtcaggtggttctg

SEQ ID NO: 419469 - DNA, 30 bp, Artificial Sequence
  Description of Artificial Sequence: Synthetic oligonucleotide
tccaggcagcattgaagtcaggtggttctg

SEQ ID NO: 419470 - DNA, 29 bp, Artificial Sequence
  Description of Artificial Sequence: Synthetic oligonucleotide
ccaggcagcattgaagtcaggtggttctg

SEQ ID NO: 419471 - DNA, 29 bp, Artificial Sequence
  Description of Artificial Sequence: Synthetic oligonucleotide
caggcagcattgaagtcaggtggttctgg

SEQ ID NO: 419472 - DNA, 32 bp, Artificial Sequence
  Description of Artificial Sequence: Synthetic oligonucleotide
aggcagcattgaagtcaggtggttctggaatg

SEQ ID NO: 419473 - DNA, 31 bp, Artificial Sequence
  Description of Artificial Sequence: Synthetic oligonucleotide
ggcagcattgaagtcaggtggttctggaatg

SEQ ID NO: 419474 - DNA, 31 bp, Artificial Sequence
  Description of Artificial Sequence: Synthetic oligonucleotide
gcagcattgaagtcaggtggttctggaatgg

SEQ ID NO: 419475 - DNA, 31 bp, Artificial Sequence
  Description of Artificial Sequence: Synthetic oligonucleotide
cagcattgaagtcaggtggttctggaatggc

SEQ ID NO: 419476 - DNA, 31 bp, Artificial Sequence
  Description of Artificial Sequence: Synthetic oligonucleotide
agcattgaagtcaggtggttctggaatggcc

SEQ ID NO: 419477 - DNA, 30 bp, Artificial Sequence
  Description of Artificial Sequence: Synthetic oligonucleotide
gcattgaagtcaggtggttctggaatggcc

SEQ ID NO: 419478 - DNA, 31 bp, Artificial Sequence
  Description of Artificial Sequence: Synthetic oligonucleotide
cattgaagtcaggtggttctggaatggccag

SEQ ID NO: 419479 - DNA, 31 bp, Artificial Sequence
  Description of Artificial Sequence: Synthetic oligonucleotide
attgaagtcaggtggttctggaatggccagg

SEQ ID NO: 419480 - DNA, 30 bp, Artificial Sequence
  Description of Artificial Sequence: Synthetic oligonucleotide
ttgaagtcaggtggttctggaatggccagg

SEQ ID NO: 419481 - DNA, 29 bp, Artificial Sequence
  Description of Artificial Sequence: Synthetic oligonucleotide
tgaagtcaggtggttctggaatggccagg

SEQ ID NO: 419482 - DNA, 28 bp, Artificial Sequence
  Description of Artificial Sequence: Synthetic oligonucleotide
gaagtcaggtggttctggaatggccagg

SEQ ID NO: 419483 - DNA, 30 bp, Artificial Sequence
  Description of Artificial Sequence: Synthetic oligonucleotide
aagtcaggtggttctggaatggccaggaag

SEQ ID NO: 419484 - DNA, 29 bp, Artificial Sequence
  Description of Artificial Sequence: Synthetic oligonucleotide
agtcaggtggttctggaatggccaggaag

SEQ ID NO: 419485 - DNA, 28 bp, Artificial Sequence
  Description of Artificial Sequence: Synthetic oligonucleotide
gtcaggtggttctggaatggccaggaag

SEQ ID NO: 419486 - DNA, 29 bp, Artificial Sequence
  Description of Artificial Sequence: Synthetic oligonucleotide
tcaggtggttctggaatggccaggaagag

SEQ ID NO: 419487 - DNA, 28 bp, Artificial Sequence
  Description of Artificial Sequence: Synthetic oligonucleotide
caggtggttctggaatggccaggaagag

SEQ ID NO: 419488 - DNA, 30 bp, Artificial Sequence
  Description of Artificial Sequence: Synthetic oligonucleotide
aggtggttctggaatggccaggaagagaag

SEQ ID NO: 419489 - DNA, 29 bp, Artificial Sequence
  Description of Artificial Sequence: Synthetic oligonucleotide
ggtggttctggaatggccaggaagagaag

SEQ ID NO: 419490 - DNA, 30 bp, Artificial Sequence
  Description of Artificial Sequence: Synthetic oligonucleotide
gtggttctggaatggccaggaagagaagac

SEQ ID NO: 419491 - DNA, 31 bp, Artificial Sequence
  Description of Artificial Sequence: Synthetic oligonucleotide
tggttctggaatggccaggaagagaagactg

SEQ ID NO: 419492 - DNA, 30 bp, Artificial Sequence
  Description of Artificial Sequence: Synthetic oligonucleotide
ggttctggaatggccaggaagagaagactg

SEQ ID NO: 419493 - DNA, 30 bp, Artificial Sequence
  Description of Artificial Sequence: Synthetic oligonucleotide
gttctggaatggccaggaagagaagactgg

SEQ ID NO: 419494 - DNA, 30 bp, Artificial Sequence
  Description of Artificial Sequence: Synthetic oligonucleotide
ttctggaatggccaggaagagaagactggg

SEQ ID NO: 419495 - DNA, 29 bp, Artificial Sequence
  Description of Artificial Sequence: Synthetic oligonucleotide
tctggaatggccaggaagagaagactggg

SEQ ID NO: 419496 - DNA, 28 bp, Artificial Sequence
  Description of Artificial Sequence: Synthetic oligonucleotide
ctggaatggccaggaagagaagactggg

SEQ ID NO: 419497 - DNA, 28 bp, Artificial Sequence
  Description of Artificial Sequence: Synthetic oligonucleotide
tggaatggccaggaagagaagactgggg

SEQ ID NO: 419498 - DNA, 22 bp, Artificial Sequence
  Description of Artificial Sequence: Synthetic oligonucleotide
gtgagggagctggggcggccta

SEQ ID NO: 419499 - DNA, 22 bp, Artificial Sequence
  Description of Artificial Sequence: Synthetic oligonucleotide
tgagggagctggggcggcctag

SEQ ID NO: 419500 - DNA, 21 bp, Artificial Sequence
  Description of Artificial Sequence: Synthetic oligonucleotide
gagggagctggggcggcctag

SEQ ID NO: 419501 - DNA, 21 bp, Artificial Sequence
  Description of Artificial Sequence: Synthetic oligonucleotide
agggagctggggcggcctagc

SEQ ID NO: 419502 - DNA, 20 bp, Artificial Sequence
  Description of Artificial Sequence: Synthetic oligonucleotide
gggagctggggcggcctagc

SEQ ID NO: 419503 - DNA, 33 bp, Artificial Sequence; identical to SEQ ID NO: 71486
  Description of Artificial Sequence: Synthetic oligonucleotide

SEQ ID NO: 419504 - DNA, 33 bp, Artificial Sequence; identical to SEQ ID NO: 71487
  Description of Artificial Sequence: Synthetic oligonucleotide

SEQ ID NO: 419505 - DNA, 32 bp, Artificial Sequence; identical to SEQ ID NO: 71488
  Description of Artificial Sequence: Synthetic oligonucleotide

SEQ ID NO: 419506 - DNA, 33 bp, Artificial Sequence; identical to SEQ ID NO: 71489
  Description of Artificial Sequence: Synthetic oligonucleotide

SEQ ID NO: 419507 - DNA, 33 bp, Artificial Sequence; identical to SEQ ID NO: 71490
  Description of Artificial Sequence: Synthetic oligonucleotide

SEQ ID NO: 419508 - DNA, 32 bp, Artificial Sequence; identical to SEQ ID NO: 71491
  Description of Artificial Sequence: Synthetic oligonucleotide

SEQ ID NO: 419509 - DNA, 30 bp, Artificial Sequence; identical to SEQ ID NO: 71499
  Description of Artificial Sequence: Synthetic oligonucleotide

SEQ ID NO: 419510 - DNA, 29 bp, Artificial Sequence
  Description of Artificial Sequence: Synthetic oligonucleotide
cctactgcagacacaactaccgggttgtg

SEQ ID NO: 419511 - DNA, 29 bp, Artificial Sequence
  Description of Artificial Sequence: Synthetic oligonucleotide
ctactgcagacacaactaccgggttgtgg

SEQ ID NO: 419512 - DNA, 30 bp, Artificial Sequence; identical to SEQ ID NO: 71502
  Description of Artificial Sequence: Synthetic oligonucleotide

SEQ ID NO: 419513 - DNA, 29 bp, Artificial Sequence
  Description of Artificial Sequence: Synthetic oligonucleotide
actgcagacacaactaccgggttgtggag

SEQ ID NO: 419514 - DNA, 28 bp, Artificial Sequence
  Description of Artificial Sequence: Synthetic oligonucleotide
ctgcagacacaactaccgggttgtggag

SEQ ID NO: 419515 - DNA, 29 bp, Artificial Sequence
  Description of Artificial Sequence: Synthetic oligonucleotide
tgcagacacaactaccgggttgtggagag

SEQ ID NO: 419516 - DNA, 28 bp, Artificial Sequence
  Description of Artificial Sequence: Synthetic oligonucleotide
gcagacacaactaccgggttgtggagag

SEQ ID NO: 419517 - DNA, 28 bp, Artificial Sequence
  Description of Artificial Sequence: Synthetic oligonucleotide
cagacacaactaccgggttgtggagagc

SEQ ID NO: 419518 - DNA, 30 bp, Artificial Sequence; identical to SEQ ID NO: 71508
  Description of Artificial Sequence: Synthetic oligonucleotide

SEQ ID NO: 419519 - DNA, 29 bp, Artificial Sequence
  Description of Artificial Sequence: Synthetic oligonucleotide
gacacaactaccgggttgtggagagcttc

SEQ ID NO: 419520 - DNA, 30 bp, Artificial Sequence; identical to SEQ ID NO: 71510
  Description of Artificial Sequence: Synthetic oligonucleotide

SEQ ID NO: 419521 - DNA, 22 bp, Artificial Sequence
  Description of Artificial Sequence: Synthetic oligonucleotide
tggggcggcctgtcgccgagta

SEQ ID NO: 419522 - DNA, 25 bp, Artificial Sequence
  Description of Artificial Sequence: Synthetic oligonucleotide
aagacaagcgggccgcggtggacaa

SEQ ID NO: 419523 - DNA, 24 bp, Artificial Sequence
  Description of Artificial Sequence: Synthetic oligonucleotide
agacaagcgggccgcggtggacaa

SEQ ID NO: 419524 - DNA, 23 bp, Artificial Sequence
  Description of Artificial Sequence: Synthetic oligonucleotide
gacaagcgggccgcggtggacaa

SEQ ID NO: 419525 - DNA, 25 bp, Artificial Sequence
  Description of Artificial Sequence: Synthetic oligonucleotide
acaagcgggccgcggtggacaacta

SEQ ID NO: 419526 - DNA, 24 bp, Artificial Sequence
  Description of Artificial Sequence: Synthetic oligonucleotide
caagcgggccgcggtggacaacta

SEQ ID NO: 419527 - DNA, 27 bp, Artificial Sequence
  Description of Artificial Sequence: Synthetic oligonucleotide
aagacaagcgggccgcggtggacaatt

SEQ ID NO: 419528 - DNA, 27 bp, Artificial Sequence
  Description of Artificial Sequence: Synthetic oligonucleotide
agacaagcgggccgcggtggacaatta

SEQ ID NO: 419529 - DNA, 26 bp, Artificial Sequence
  Description of Artificial Sequence: Synthetic oligonucleotide
gacaagcgggccgcggtggacaatta

SEQ ID NO: 419530 - DNA, 27 bp, Artificial Sequence
  Description of Artificial Sequence: Synthetic oligonucleotide
acaagcgggccgcggtggacaattact

SEQ ID NO: 419531 - DNA, 26 bp, Artificial Sequence
  Description of Artificial Sequence: Synthetic oligonucleotide
caagcgggccgcggtggacaattact

SEQ ID NO: 419532 - DNA, 33 bp, Artificial Sequence; identical to SEQ ID NO: 71522
  Description of Artificial Sequence: Synthetic oligonucleotide

SEQ ID NO: 419533 - DNA, 32 bp, Artificial Sequence; identical to SEQ ID NO: 71523
  Description of Artificial Sequence: Synthetic oligonucleotide

SEQ ID NO: 419534 - DNA, 33 bp, Artificial Sequence; identical to SEQ ID NO: 71524
  Description of Artificial Sequence: Synthetic oligonucleotide

SEQ ID NO: 419535 - DNA, 33 bp, Artificial Sequence; identical to SEQ ID NO: 71525
  Description of Artificial Sequence: Synthetic oligonucleotide

SEQ ID NO: 419536 - DNA, 32 bp, Artificial Sequence; identical to SEQ ID NO: 71526
  Description of Artificial Sequence: Synthetic oligonucleotide

SEQ ID NO: 419537 - DNA, 32 bp, Artificial Sequence; identical to SEQ ID NO: 71527
  Description of Artificial Sequence: Synthetic oligonucleotide

SEQ ID NO: 419538 - DNA, 31 bp, Artificial Sequence; identical to SEQ ID NO: 71528
  Description of Artificial Sequence: Synthetic oligonucleotide

SEQ ID NO: 419539 - DNA, 31 bp, Artificial Sequence; identical to SEQ ID NO: 71529
  Description of Artificial Sequence: Synthetic oligonucleotide

SEQ ID NO: 419540 - DNA, 30 bp, Artificial Sequence; identical to SEQ ID NO: 71530
  Description of Artificial Sequence: Synthetic oligonucleotide

SEQ ID NO: 419541 - DNA, 29 bp, Artificial Sequence
  Description of Artificial Sequence: Synthetic oligonucleotide
acttccataaccaggaggagaacctgcgc

SEQ ID NO: 419542 - DNA, 28 bp, Artificial Sequence
  Description of Artificial Sequence: Synthetic oligonucleotide
cttccataaccaggaggagaacctgcgc

SEQ ID NO: 419543 - DNA, 30 bp, Artificial Sequence; identical to SEQ ID NO: 71533
  Description of Artificial Sequence: Synthetic oligonucleotide

SEQ ID NO: 419544 - DNA, 29 bp, Artificial Sequence
  Description of Artificial Sequence: Synthetic oligonucleotide
tccataaccaggaggagaacctgcgcttc

SEQ ID NO: 419545 - DNA, 28 bp, Artificial Sequence
  Description of Artificial Sequence: Synthetic oligonucleotide
ccataaccaggaggagaacctgcgcttc

SEQ ID NO: 419546 - DNA, 28 bp, Artificial Sequence
  Description of Artificial Sequence: Synthetic oligonucleotide
cataaccaggaggagaacctgcgcttcg

SEQ ID NO: 419547 - DNA, 29 bp, Artificial Sequence
  Description of Artificial Sequence: Synthetic oligonucleotide
ataaccaggaggagaacctgcgcttcgac

SEQ ID NO: 419548 - DNA, 28 bp, Artificial Sequence
  Description of Artificial Sequence: Synthetic oligonucleotide
taaccaggaggagaacctgcgcttcgac

SEQ ID NO: 419549 - DNA, 27 bp, Artificial Sequence
  Description of Artificial Sequence: Synthetic oligonucleotide
aaccaggaggagaacctgcgcttcgac

SEQ ID NO: 419550 - DNA, 27 bp, Artificial Sequence
  Description of Artificial Sequence: Synthetic oligonucleotide
accaggaggagaacctgcgcttcgaca

SEQ ID NO: 419551 - DNA, 26 bp, Artificial Sequence
  Description of Artificial Sequence: Synthetic oligonucleotide
ccaggaggagaacctgcgcttcgaca

SEQ ID NO: 419552 - DNA, 26 bp, Artificial Sequence
  Description of Artificial Sequence: Synthetic oligonucleotide
caggaggagaacctgcgcttcgacag

SEQ ID NO: 419553 - DNA, 26 bp, Artificial Sequence
  Description of Artificial Sequence: Synthetic oligonucleotide
aggaggagaacctgcgcttcgacagc

SEQ ID NO: 419554 - DNA, 25 bp, Artificial Sequence
  Description of Artificial Sequence: Synthetic oligonucleotide
ggaggagaacctgcgcttcgacagc

SEQ ID NO: 419555 - DNA, 26 bp, Artificial Sequence
  Description of Artificial Sequence: Synthetic oligonucleotide
gaggagaacctgcgcttcgacagcga

SEQ ID NO: 419556 - DNA, 26 bp, Artificial Sequence
  Description of Artificial Sequence: Synthetic oligonucleotide
aggagaacctgcgcttcgacagcgac

SEQ ID NO: 419557 - DNA, 25 bp, Artificial Sequence
  Description of Artificial Sequence: Synthetic oligonucleotide
ggagaacctgcgcttcgacagcgac

SEQ ID NO: 419558 - DNA, 26 bp, Artificial Sequence
  Description of Artificial Sequence: Synthetic oligonucleotide
gagaacctgcgcttcgacagcgacgt

SEQ ID NO: 419559 - DNA, 26 bp, Artificial Sequence
  Description of Artificial Sequence: Synthetic oligonucleotide
agaacctgcgcttcgacagcgacgtg

SEQ ID NO: 419560 - DNA, 25 bp, Artificial Sequence
  Description of Artificial Sequence: Synthetic oligonucleotide
gaacctgcgcttcgacagcgacgtg

SEQ ID NO: 419561 - DNA, 25 bp, Artificial Sequence
  Description of Artificial Sequence: Synthetic oligonucleotide
aacctgcgcttcgacagcgacgtgg

SEQ ID NO: 419562 - DNA, 26 bp, Artificial Sequence
  Description of Artificial Sequence: Synthetic oligonucleotide
ttcgacagcgacgtgggggagttcct

SEQ ID NO: 419563 - DNA, 25 bp, Artificial Sequence
  Description of Artificial Sequence: Synthetic oligonucleotide
tcgacagcgacgtgggggagttcct

SEQ ID NO: 419564 - DNA, 24 bp, Artificial Sequence
  Description of Artificial Sequence: Synthetic oligonucleotide
cgacagcgacgtgggggagttcct

SEQ ID NO: 419565 - DNA, 24 bp, Artificial Sequence
  Description of Artificial Sequence: Synthetic oligonucleotide
gacagcgacgtgggggagttcctg

SEQ ID NO: 419566 - DNA, 24 bp, Artificial Sequence
  Description of Artificial Sequence: Synthetic oligonucleotide
acagcgacgtgggggagttcctgg

SEQ ID NO: 419567 - DNA, 23 bp, Artificial Sequence
  Description of Artificial Sequence: Synthetic oligonucleotide
cagcgacgtgggggagttcctgg

SEQ ID NO: 419568 - DNA, 23 bp, Artificial Sequence
  Description of Artificial Sequence: Synthetic oligonucleotide
agcgacgtgggggagttcctggc

SEQ ID NO: 419569 - DNA, 22 bp, Artificial Sequence
  Description of Artificial Sequence: Synthetic oligonucleotide
gcgacgtgggggagttcctggc

SEQ ID NO: 419570 - DNA, 22 bp, Artificial Sequence
  Description of Artificial Sequence: Synthetic oligonucleotide
cgacgtgggggagttcctggcg

SEQ ID NO: 419571 - DNA, 23 bp, Artificial Sequence
  Description of Artificial Sequence: Synthetic oligonucleotide
gacgtgggggagttcctggcggt

SEQ ID NO: 419572 - DNA, 24 bp, Artificial Sequence
  Description of Artificial Sequence: Synthetic oligonucleotide
acgtgggggagttcctggcggtga

SEQ ID NO: 419573 - DNA, 23 bp, Artificial Sequence
  Description of Artificial Sequence: Synthetic oligonucleotide
cgtgggggagttcctggcggtga

SEQ ID NO: 419574 - DNA, 23 bp, Artificial Sequence
  Description of Artificial Sequence: Synthetic oligonucleotide
gtgggggagttcctggcggtgac

SEQ ID NO: 419575 - DNA, 23 bp, Artificial Sequence
  Description of Artificial Sequence: Synthetic oligonucleotide
tgggggagttcctggcggtgacg

SEQ ID NO: 419576 - DNA, 22 bp, Artificial Sequence
  Description of Artificial Sequence: Synthetic oligonucleotide
gggggagttcctggcggtgacg

SEQ ID NO: 419577 - DNA, 23 bp, Artificial Sequence
  Description of Artificial Sequence: Synthetic oligonucleotide
ggggagttcctggcggtgacgga

SEQ ID NO: 419578 - DNA, 23 bp, Artificial Sequence
  Description of Artificial Sequence: Synthetic oligonucleotide
gggagttcctggcggtgacggag

SEQ ID NO: 419579 - DNA, 24 bp, Artificial Sequence
  Description of Artificial Sequence: Synthetic oligonucleotide
ggagttcctggcggtgacggagct

SEQ ID NO: 419580 - DNA, 24 bp, Artificial Sequence
  Description of Artificial Sequence: Synthetic oligonucleotide
gagttcctggcggtgacggagctg

SEQ ID NO: 419581 - DNA, 24 bp, Artificial Sequence
  Description of Artificial Sequence: Synthetic oligonucleotide
agttcctggcggtgacggagctgg

SEQ ID NO: 419582 - DNA, 23 bp, Artificial Sequence
  Description of Artificial Sequence: Synthetic oligonucleotide
gttcctggcggtgacggagctgg

SEQ ID NO: 419583 - DNA, 23 bp, Artificial Sequence
  Description of Artificial Sequence: Synthetic oligonucleotide
ttcctggcggtgacggagctggg

SEQ ID NO: 419584 - DNA, 22 bp, Artificial Sequence
  Description of Artificial Sequence: Synthetic oligonucleotide
tcctggcggtgacggagctggg

SEQ ID NO: 419585 - DNA, 21 bp, Artificial Sequence
  Description of Artificial Sequence: Synthetic oligonucleotide
cctggcggtgacggagctggg

SEQ ID NO: 419586 - DNA, 21 bp, Artificial Sequence
  Description of Artificial Sequence: Synthetic oligonucleotide
ctggcggtgacggagctgggg

SEQ ID NO: 419587 - DNA, 21 bp, Artificial Sequence
  Description of Artificial Sequence: Synthetic oligonucleotide
tggcggtgacggagctggggc

SEQ ID NO: 419588 - DNA, 23 bp, Artificial Sequence
  Description of Artificial Sequence: Synthetic oligonucleotide
gacgtgggggagttccgggcgtt

SEQ ID NO: 419589 - DNA, 24 bp, Artificial Sequence
  Description of Artificial Sequence: Synthetic oligonucleotide
acgtgggggagttccgggcgttga

SEQ ID NO: 419590 - DNA, 23 bp, Artificial Sequence
  Description of Artificial Sequence: Synthetic oligonucleotide
cgtgggggagttccgggcgttga

SEQ ID NO: 419591 - DNA, 23 bp, Artificial Sequence
  Description of Artificial Sequence: Synthetic oligonucleotide
gtgggggagttccgggcgttgac

SEQ ID NO: 419592 - DNA, 23 bp, Artificial Sequence
  Description of Artificial Sequence: Synthetic oligonucleotide
tgggggagttccgggcgttgacg

SEQ ID NO: 419593 - DNA, 22 bp, Artificial Sequence
  Description of Artificial Sequence: Synthetic oligonucleotide
gggggagttccgggcgttgacg

SEQ ID NO: 419594 - DNA, 23 bp, Artificial Sequence
  Description of Artificial Sequence: Synthetic oligonucleotide
ggggagttccgggcgttgacgga

SEQ ID NO: 419595 - DNA, 23 bp, Artificial Sequence
  Description of Artificial Sequence: Synthetic oligonucleotide
gggagttccgggcgttgacggag

SEQ ID NO: 419596 - DNA, 24 bp, Artificial Sequence
  Description of Artificial Sequence: Synthetic oligonucleotide
ggagttccgggcgttgacggagct

SEQ ID NO: 419597 - DNA, 24 bp, Artificial Sequence
  Description of Artificial Sequence: Synthetic oligonucleotide
gagttccgggcgttgacggagctg

SEQ ID NO: 419598 - DNA, 24 bp, Artificial Sequence
  Description of Artificial Sequence: Synthetic oligonucleotide
agttccgggcgttgacggagctgg

SEQ ID NO: 419599 - DNA, 23 bp, Artificial Sequence
  Description of Artificial Sequence: Synthetic oligonucleotide
gttccgggcgttgacggagctgg

SEQ ID NO: 419600 - DNA, 23 bp, Artificial Sequence
  Description of Artificial Sequence: Synthetic oligonucleotide
ttccgggcgttgacggagctggg

SEQ ID NO: 419601 - DNA, 22 bp, Artificial Sequence
  Description of Artificial Sequence: Synthetic oligonucleotide
tccgggcgttgacggagctggg

SEQ ID NO: 419602 - DNA, 21 bp, Artificial Sequence
  Description of Artificial Sequence: Synthetic oligonucleotide
ccgggcgttgacggagctggg

SEQ ID NO: 419603 - DNA, 21 bp, Artificial Sequence
  Description of Artificial Sequence: Synthetic oligonucleotide
cgggcgttgacggagctgggg

SEQ ID NO: 419604 - DNA, 21 bp, Artificial Sequence
  Description of Artificial Sequence: Synthetic oligonucleotide
gggcgttgacggagctggggc

SEQ ID NO: 419605 - DNA, 21 bp, Artificial Sequence
  Description of Artificial Sequence: Synthetic oligonucleotide
ggcgttgacggagctggggcg

SEQ ID NO: 419606 - DNA, 21 bp, Artificial Sequence
  Description of Artificial Sequence: Synthetic oligonucleotide
gcgttgacggagctggggcgg

SEQ ID NO: 419607 - DNA, 21 bp, Artificial Sequence
  Description of Artificial Sequence: Synthetic oligonucleotide
cgttgacggagctggggcggc

SEQ ID NO: 419608 - DNA, 22 bp, Artificial Sequence
  Description of Artificial Sequence: Synthetic oligonucleotide
gttgacggagctggggcggcct

SEQ ID NO: 419609 - DNA, 24 bp, Artificial Sequence
  Description of Artificial Sequence: Synthetic oligonucleotide
ttgacggagctggggcggcctgat

SEQ ID NO: 419610 - DNA, 22 bp, Artificial Sequence
  Description of Artificial Sequence: Synthetic oligonucleotide
ggacggagcgggtgcggttcca

SEQ ID NO: 419611 - DNA, 22 bp, Artificial Sequence
  Description of Artificial Sequence: Synthetic oligonucleotide
gacggagcgggtgcggttccag

SEQ ID NO: 419612 - DNA, 23 bp, Artificial Sequence
  Description of Artificial Sequence: Synthetic oligonucleotide
acggagcgggtgcggttccagga

SEQ ID NO: 419613 - DNA, 22 bp, Artificial Sequence
  Description of Artificial Sequence: Synthetic oligonucleotide
cggagcgggtgcggttccagga

SEQ ID NO: 419614 - DNA, 23 bp, Artificial Sequence
  Description of Artificial Sequence: Synthetic oligonucleotide
ggagcgggtgcggttccaggaca

SEQ ID NO: 419615 - DNA, 26 bp, Artificial Sequence
  Description of Artificial Sequence: Synthetic oligonucleotide
gagcgggtgcggttccaggacagata

SEQ ID NO: 419616 - DNA, 27 bp, Artificial Sequence
  Description of Artificial Sequence: Synthetic oligonucleotide
agcgggtgcggttccaggacagatact

SEQ ID NO: 419617 - DNA, 27 bp, Artificial Sequence
  Description of Artificial Sequence: Synthetic oligonucleotide
gcgggtgcggttccaggacagatactt

SEQ ID NO: 419618 - DNA, 27 bp, Artificial Sequence
  Description of Artificial Sequence: Synthetic oligonucleotide
cgggtgcggttccaggacagatacttc

SEQ ID NO: 419619 - DNA, 27 bp, Artificial Sequence
  Description of Artificial Sequence: Synthetic oligonucleotide
gggtgcggttccaggacagatacttcc

SEQ ID NO: 419620 - DNA, 31 bp, Artificial Sequence; identical to SEQ ID NO: 71611
  Description of Artificial Sequence: Synthetic oligonucleotide

SEQ ID NO: 419621 - DNA, 31 bp, Artificial Sequence; identical to SEQ ID NO: 71612
  Description of Artificial Sequence: Synthetic oligonucleotide

SEQ ID NO: 419622 - DNA, 32 bp, Artificial Sequence; identical to SEQ ID NO: 71613
  Description of Artificial Sequence: Synthetic oligonucleotide

SEQ ID NO: 419623 - DNA, 31 bp, Artificial Sequence; identical to SEQ ID NO: 71614
  Description of Artificial Sequence: Synthetic oligonucleotide

SEQ ID NO: 419624 - DNA, 31 bp, Artificial Sequence; identical to SEQ ID NO: 71615
  Description of Artificial Sequence: Synthetic oligonucleotide

SEQ ID NO: 419625 - DNA, 32 bp, Artificial Sequence; identical to SEQ ID NO: 71616
  Description of Artificial Sequence: Synthetic oligonucleotide

SEQ ID NO: 419626 - DNA, 32 bp, Artificial Sequence; identical to SEQ ID NO: 71617
  Description of Artificial Sequence: Synthetic oligonucleotide

SEQ ID NO: 419627 - DNA, 33 bp, Artificial Sequence; identical to SEQ ID NO: 71618
  Description of Artificial Sequence: Synthetic oligonucleotide

SEQ ID NO: 419628 - DNA, 32 bp, Artificial Sequence; identical to SEQ ID NO: 71619
  Description of Artificial Sequence: Synthetic oligonucleotide

SEQ ID NO: 419629 - DNA, 31 bp, Artificial Sequence; identical to SEQ ID NO: 71620
  Description of Artificial Sequence: Synthetic oligonucleotide

SEQ ID NO: 419630 - DNA, 33 bp, Artificial Sequence; identical to SEQ ID NO: 71621
  Description of Artificial Sequence: Synthetic oligonucleotide

SEQ ID NO: 419631 - DNA, 33 bp, Artificial Sequence; identical to SEQ ID NO: 71622
  Description of Artificial Sequence: Synthetic oligonucleotide

SEQ ID NO: 419632 - DNA, 35 bp, Artificial Sequence; identical to SEQ ID NO: 71623
  Description of Artificial Sequence: Synthetic oligonucleotide

SEQ ID NO: 419633 - DNA, 34 bp, Artificial Sequence; identical to SEQ ID NO: 71624
  Description of Artificial Sequence: Synthetic oligonucleotide

SEQ ID NO: 419634 - DNA, 33 bp, Artificial Sequence; identical to SEQ ID NO: 71625
  Description of Artificial Sequence: Synthetic oligonucleotide

SEQ ID NO: 419635 - DNA, 33 bp, Artificial Sequence; identical to SEQ ID NO: 71626
  Description of Artificial Sequence: Synthetic oligonucleotide

SEQ ID NO: 419636 - DNA, 33 bp, Artificial Sequence; identical to SEQ ID NO: 71627
  Description of Artificial Sequence: Synthetic oligonucleotide

SEQ ID NO: 419637 - DNA, 32 bp, Artificial Sequence; identical to SEQ ID NO: 71628
  Description of Artificial Sequence: Synthetic oligonucleotide

SEQ ID NO: 419638 - DNA, 33 bp, Artificial Sequence; identical to SEQ ID NO: 71629
  Description of Artificial Sequence: Synthetic oligonucleotide

SEQ ID NO: 419639 - DNA, 33 bp, Artificial Sequence; identical to SEQ ID NO: 71630
  Description of Artificial Sequence: Synthetic oligonucleotide

SEQ ID NO: 419640 - DNA, 32 bp, Artificial Sequence; identical to SEQ ID NO: 71631
  Description of Artificial Sequence: Synthetic oligonucleotide

SEQ ID NO: 419641 - DNA, 32 bp, Artificial Sequence; identical to SEQ ID NO: 71632
  Description of Artificial Sequence: Synthetic oligonucleotide

SEQ ID NO: 419642 - DNA, 31 bp, Artificial Sequence; identical to SEQ ID NO: 71633
  Description of Artificial Sequence: Synthetic oligonucleotide

SEQ ID NO: 419643 - DNA, 31 bp, Artificial Sequence; identical to SEQ ID NO: 71634
  Description of Artificial Sequence: Synthetic oligonucleotide

SEQ ID NO: 419644 - DNA, 30 bp, Artificial Sequence; identical to SEQ ID NO: 71635
  Description of Artificial Sequence: Synthetic oligonucleotide

SEQ ID NO: 419645 - DNA, 29 bp, Artificial Sequence
  Description of Artificial Sequence: Synthetic oligonucleotide
acttctataaccaggaggagtccgtgcgc

SEQ ID NO: 419646 - DNA, 28 bp, Artificial Sequence
  Description of Artificial Sequence: Synthetic oligonucleotide
cttctataaccaggaggagtccgtgcgc

SEQ ID NO: 419647 - DNA, 30 bp, Artificial Sequence; identical to SEQ ID NO: 71638
  Description of Artificial Sequence: Synthetic oligonucleotide

SEQ ID NO: 419648 - DNA, 25 bp, Artificial Sequence
  Description of Artificial Sequence: Synthetic oligonucleotide
acgagcgggccgcggtggacaatta

SEQ ID NO: 419649 - DNA, 24 bp, Artificial Sequence
  Description of Artificial Sequence: Synthetic oligonucleotide
cgagcgggccgcggtggacaatta

SEQ ID NO: 419650 - DNA, 25 bp, Artificial Sequence
  Description of Artificial Sequence: Synthetic oligonucleotide
gagcgggccgcggtggacaattact

SEQ ID NO: 419651 - DNA, 22 bp, Artificial Sequence
  Description of Artificial Sequence: Synthetic oligonucleotide
acgagcgggccgcggtggacaa

SEQ ID NO: 419652 - DNA, 21 bp, Artificial Sequence
  Description of Artificial Sequence: Synthetic oligonucleotide
cgagcgggccgcggtggacaa

SEQ ID NO: 419653 - DNA, 23 bp, Artificial Sequence
  Description of Artificial Sequence: Synthetic oligonucleotide
gagcgggccgcggtggacaacta

SEQ ID NO: 419654 - DNA, 31 bp, Artificial Sequence; identical to SEQ ID NO: 71642
  Description of Artificial Sequence: Synthetic oligonucleotide

SEQ ID NO: 419655 - DNA, 32 bp, Artificial Sequence; identical to SEQ ID NO: 71643
  Description of Artificial Sequence: Synthetic oligonucleotide

SEQ ID NO: 419656 - DNA, 31 bp, Artificial Sequence; identical to SEQ ID NO: 71644
  Description of Artificial Sequence: Synthetic oligonucleotide

SEQ ID NO: 419657 - DNA, 31 bp, Artificial Sequence; identical to SEQ ID NO: 71645
  Description of Artificial Sequence: Synthetic oligonucleotide

SEQ ID NO: 419658 - DNA, 32 bp, Artificial Sequence; identical to SEQ ID NO: 71646
  Description of Artificial Sequence: Synthetic oligonucleotide

SEQ ID NO: 419659 - DNA, 31 bp, Artificial Sequence; identical to SEQ ID NO: 71647
  Description of Artificial Sequence: Synthetic oligonucleotide

SEQ ID NO: 419660 - DNA, 31 bp, Artificial Sequence; identical to SEQ ID NO: 71648
  Description of Artificial Sequence: Synthetic oligonucleotide

SEQ ID NO: 419661 - DNA, 30 bp, Artificial Sequence; identical to SEQ ID NO: 71649
  Description of Artificial Sequence: Synthetic oligonucleotide

SEQ ID NO: 419662 - DNA, 30 bp, Artificial Sequence; identical to SEQ ID NO: 71650
  Description of Artificial Sequence: Synthetic oligonucleotide

SEQ ID NO: 419663 - DNA, 29 bp, Artificial Sequence
  Description of Artificial Sequence: Synthetic oligonucleotide
tacttccataaccaggaggaggacgtgcg

SEQ ID NO: 419664 - DNA, 28 bp, Artificial Sequence
  Description of Artificial Sequence: Synthetic oligonucleotide
acttccataaccaggaggaggacgtgcg

SEQ ID NO: 419665 - DNA, 27 bp, Artificial Sequence
  Description of Artificial Sequence: Synthetic oligonucleotide
cttccataaccaggaggaggacgtgcg

SEQ ID NO: 419666 - DNA, 27 bp, Artificial Sequence
  Description of Artificial Sequence: Synthetic oligonucleotide
ttccataaccaggaggaggacgtgcgc

SEQ ID NO: 419667 - DNA, 27 bp, Artificial Sequence
  Description of Artificial Sequence: Synthetic oligonucleotide
tccataaccaggaggaggacgtgcgct

SEQ ID NO: 419668 - DNA, 27 bp, Artificial Sequence
  Description of Artificial Sequence: Synthetic oligonucleotide
ccataaccaggaggaggacgtgcgctt

SEQ ID NO: 419669 - DNA, 27 bp, Artificial Sequence
  Description of Artificial Sequence: Synthetic oligonucleotide
cataaccaggaggaggacgtgcgcttc

SEQ ID NO: 419670 - DNA, 27 bp, Artificial Sequence
  Description of Artificial Sequence: Synthetic oligonucleotide
ataaccaggaggaggacgtgcgcttcg

SEQ ID NO: 419671 - DNA, 27 bp, Artificial Sequence
  Description of Artificial Sequence: Synthetic oligonucleotide
taaccaggaggaggacgtgcgcttcga

SEQ ID NO: 419672 - DNA, 26 bp, Artificial Sequence
  Description of Artificial Sequence: Synthetic oligonucleotide
aaccaggaggaggacgtgcgcttcga

SEQ ID NO: 419673 - DNA, 25 bp, Artificial Sequence
  Description of Artificial Sequence: Synthetic oligonucleotide
accaggaggaggacgtgcgcttcga

SEQ ID NO: 419674 - DNA, 24 bp, Artificial Sequence
  Description of Artificial Sequence: Synthetic oligonucleotide
ccaggaggaggacgtgcgcttcga

SEQ ID NO: 419675 - DNA, 25 bp, Artificial Sequence
  Description of Artificial Sequence: Synthetic oligonucleotide
caggaggaggacgtgcgcttcgaca

SEQ ID NO: 419676 - DNA, 25 bp, Artificial Sequence
  Description of Artificial Sequence: Synthetic oligonucleotide
aggaggaggacgtgcgcttcgacag

SEQ ID NO: 419677 - DNA, 24 bp, Artificial Sequence
  Description of Artificial Sequence: Synthetic oligonucleotide
ggaggaggacgtgcgcttcgacag

SEQ ID NO: 419678 - DNA, 28 bp, Artificial Sequence
  Description of Artificial Sequence: Synthetic oligonucleotide
cgggtgctgttcctggacagatacttcc

SEQ ID NO: 419679 - DNA, 32 bp, Artificial Sequence; identical to SEQ ID NO: 71667
  Description of Artificial Sequence: Synthetic oligonucleotide

SEQ ID NO: 419680 - DNA, 32 bp, Artificial Sequence; identical to SEQ ID NO: 71668
  Description of Artificial Sequence: Synthetic oligonucleotide

SEQ ID NO: 419681 - DNA, 33 bp, Artificial Sequence; identical to SEQ ID NO: 71669
  Description of Artificial Sequence: Synthetic oligonucleotide

SEQ ID NO: 419682 - DNA, 33 bp, Artificial Sequence; identical to SEQ ID NO: 71670
  Description of Artificial Sequence: Synthetic oligonucleotide

SEQ ID NO: 419683 - DNA, 32 bp, Artificial Sequence; identical to SEQ ID NO: 71671
  Description of Artificial Sequence: Synthetic oligonucleotide

SEQ ID NO: 419684 - DNA, 33 bp, Artificial Sequence; identical to SEQ ID NO: 71672
  Description of Artificial Sequence: Synthetic oligonucleotide

SEQ ID NO: 419685 - DNA, 33 bp, Artificial Sequence; identical to SEQ ID NO: 71673
  Description of Artificial Sequence: Synthetic oligonucleotide

SEQ ID NO: 419686 - DNA, 29 bp, Artificial Sequence
  Description of Artificial Sequence: Synthetic oligonucleotide
gagtactggaacagccagaaggacatccg

SEQ ID NO: 419687 - DNA, 29 bp, Artificial Sequence
  Description of Artificial Sequence: Synthetic oligonucleotide
agtactggaacagccagaaggacatccgg

SEQ ID NO: 419688 - DNA, 28 bp, Artificial Sequence
  Description of Artificial Sequence: Synthetic oligonucleotide
gtactggaacagccagaaggacatccgg

SEQ ID NO: 419689 - DNA, 28 bp, Artificial Sequence
  Description of Artificial Sequence: Synthetic oligonucleotide
tactggaacagccagaaggacatccggg

SEQ ID NO: 419690 - DNA, 27 bp, Artificial Sequence
  Description of Artificial Sequence: Synthetic oligonucleotide
actggaacagccagaaggacatccggg

SEQ ID NO: 419691 - DNA, 27 bp, Artificial Sequence
  Description of Artificial Sequence: Synthetic oligonucleotide
ctggaacagccagaaggacatccggga

SEQ ID NO: 419692 - DNA, 28 bp, Artificial Sequence
  Description of Artificial Sequence: Synthetic oligonucleotide
tggaacagccagaaggacatccgggaag

SEQ ID NO: 419693 - DNA, 27 bp, Artificial Sequence
  Description of Artificial Sequence: Synthetic oligonucleotide
ggaacagccagaaggacatccgggaag

SEQ ID NO: 419694 - DNA, 28 bp, Artificial Sequence
  Description of Artificial Sequence: Synthetic oligonucleotide
gaacagccagaaggacatccgggaagac

SEQ ID NO: 419695 - DNA, 28 bp, Artificial Sequence
  Description of Artificial Sequence: Synthetic oligonucleotide
aacagccagaaggacatccgggaagacg

SEQ ID NO: 419696 - DNA, 27 bp, Artificial Sequence
  Description of Artificial Sequence: Synthetic oligonucleotide
acagccagaaggacatccgggaagacg

SEQ ID NO: 419697 - DNA, 27 bp, Artificial Sequence
  Description of Artificial Sequence: Synthetic oligonucleotide
cagccagaaggacatccgggaagacga

SEQ ID NO: 419698 - DNA, 27 bp, Artificial Sequence
  Description of Artificial Sequence: Synthetic oligonucleotide
agccagaaggacatccgggaagacgag

SEQ ID NO: 419699 - DNA, 26 bp, Artificial Sequence
  Description of Artificial Sequence: Synthetic oligonucleotide
gccagaaggacatccgggaagacgag

SEQ ID NO: 419700 - DNA, 26 bp, Artificial Sequence
  Description of Artificial Sequence: Synthetic oligonucleotide
ccagaaggacatccgggaagacgagc

SEQ ID NO: 419701 - DNA, 26 bp, Artificial Sequence
  Description of Artificial Sequence: Synthetic oligonucleotide
cagaaggacatccgggaagacgagcg

SEQ ID NO: 419702 - DNA, 26 bp, Artificial Sequence
  Description of Artificial Sequence: Synthetic oligonucleotide
agaaggacatccgggaagacgagcgg

SEQ ID NO: 419703 - DNA, 25 bp, Artificial Sequence
  Description of Artificial Sequence: Synthetic oligonucleotide
gaaggacatccgggaagacgagcgg

SEQ ID NO: 419704 - DNA, 25 bp, Artificial Sequence
  Description of Artificial Sequence: Synthetic oligonucleotide
aaggacatccgggaagacgagcggg

SEQ ID NO: 419705 - DNA, 24 bp, Artificial Sequence
  Description of Artificial Sequence: Synthetic oligonucleotide
aggacatccgggaagacgagcggg

SEQ ID NO: 419706 - DNA, 23 bp, Artificial Sequence
  Description of Artificial Sequence: Synthetic oligonucleotide
ggacatccgggaagacgagcggg

SEQ ID NO: 419707 - DNA, 23 bp, Artificial Sequence
  Description of Artificial Sequence: Synthetic oligonucleotide
gacatccgggaagacgagcgggc

SEQ ID NO: 419708 - DNA, 23 bp, Artificial Sequence
  Description of Artificial Sequence: Synthetic oligonucleotide
acatccgggaagacgagcgggcc

SEQ ID NO: 419709 - DNA, 22 bp, Artificial Sequence
  Description of Artificial Sequence: Synthetic oligonucleotide
catccgggaagacgagcgggcc

SEQ ID NO: 419710 - DNA, 22 bp, Artificial Sequence
  Description of Artificial Sequence: Synthetic oligonucleotide
atccgggaagacgagcgggccg

SEQ ID NO: 419711 - DNA, 21 bp, Artificial Sequence
  Description of Artificial Sequence: Synthetic oligonucleotide
tccgggaagacgagcgggccg

SEQ ID NO: 419712 - DNA, 20 bp, Artificial Sequence
  Description of Artificial Sequence: Synthetic oligonucleotide
ccgggaagacgagcgggccg

SEQ ID NO: 419713 - DNA, 20 bp, Artificial Sequence
  Description of Artificial Sequence: Synthetic oligonucleotide
cgggaagacgagcgggccgc

SEQ ID NO: 419714 - DNA, 20 bp, Artificial Sequence
  Description of Artificial Sequence: Synthetic oligonucleotide
gggaagacgagcgggccgcg

SEQ ID NO: 419715 - DNA, 25 bp, Artificial Sequence
  Description of Artificial Sequence: Synthetic oligonucleotide
acatcctggaagacgagcgggccga

SEQ ID NO: 419716 - DNA, 24 bp, Artificial Sequence
  Description of Artificial Sequence: Synthetic oligonucleotide
catcctggaagacgagcgggccga

SEQ ID NO: 419717 - DNA, 24 bp, Artificial Sequence
  Description of Artificial Sequence: Synthetic oligonucleotide
atcctggaagacgagcgggccgag

SEQ ID NO: 419718 - DNA, 23 bp, Artificial Sequence
  Description of Artificial Sequence: Synthetic oligonucleotide
tcctggaagacgagcgggccgag

SEQ ID NO: 419719 - DNA, 22 bp, Artificial Sequence
  Description of Artificial Sequence: Synthetic oligonucleotide
cctggaagacgagcgggccgag

SEQ ID NO: 419720 - DNA, 23 bp, Artificial Sequence
  Description of Artificial Sequence: Synthetic oligonucleotide
ctggaagacgagcgggccgaggt

SEQ ID NO: 419721 - DNA, 23 bp, Artificial Sequence
  Description of Artificial Sequence: Synthetic oligonucleotide
tggaagacgagcgggccgaggtg

SEQ ID NO: 419722 - DNA, 22 bp, Artificial Sequence
  Description of Artificial Sequence: Synthetic oligonucleotide
ggaagacgagcgggccgaggtg

SEQ ID NO: 419723 - DNA, 23 bp, Artificial Sequence
  Description of Artificial Sequence: Synthetic oligonucleotide
gaagacgagcgggccgaggtgga

SEQ ID NO: 419724 - DNA, 24 bp, Artificial Sequence
  Description of Artificial Sequence: Synthetic oligonucleotide
aagacgagcgggccgaggtggaca

SEQ ID NO: 419725 - DNA, 23 bp, Artificial Sequence
  Description of Artificial Sequence: Synthetic oligonucleotide
agacgagcgggccgaggtggaca

SEQ ID NO: 419726 - DNA, 22 bp, Artificial Sequence
  Description of Artificial Sequence: Synthetic oligonucleotide
gacgagcgggccgaggtggaca

SEQ ID NO: 419727 - DNA, 22 bp, Artificial Sequence
  Description of Artificial Sequence: Synthetic oligonucleotide
acgagcgggccgaggtggacac

SEQ ID NO: 419728 - DNA, 21 bp, Artificial Sequence
  Description of Artificial Sequence: Synthetic oligonucleotide
cgagcgggccgaggtggacac

SEQ ID NO: 419729 - DNA, 25 bp, Artificial Sequence
  Description of Artificial Sequence: Synthetic oligonucleotide
gagcgggccgaggtggacacctatt

SEQ ID NO: 419730 - DNA, 25 bp, Artificial Sequence
  Description of Artificial Sequence: Synthetic oligonucleotide
agcgggccgaggtggacacctattg

SEQ ID NO: 419731 - DNA, 32 bp, Artificial Sequence; identical to SEQ ID NO: 71719
  Description of Artificial Sequence: Synthetic oligonucleotide

SEQ ID NO: 419732 - DNA, 32 bp, Artificial Sequence; identical to SEQ ID NO: 71720
  Description of Artificial Sequence: Synthetic oligonucleotide

SEQ ID NO: 419733 - DNA, 34 bp, Artificial Sequence; identical to SEQ ID NO: 71721
  Description of Artificial Sequence: Synthetic oligonucleotide

SEQ ID NO: 419734 - DNA, 35 bp, Artificial Sequence; identical to SEQ ID NO: 71722
  Description of Artificial Sequence: Synthetic oligonucleotide

SEQ ID NO: 419735 - DNA, 34 bp, Artificial Sequence; identical to SEQ ID NO: 71723
  Description of Artificial Sequence: Synthetic oligonucleotide

SEQ ID NO: 419736 - DNA, 34 bp, Artificial Sequence; identical to SEQ ID NO: 71724
  Description of Artificial Sequence: Synthetic oligonucleotide

SEQ ID NO: 419737 - DNA, 35 bp, Artificial Sequence; identical to SEQ ID NO: 71725
  Description of Artificial Sequence: Synthetic oligonucleotide

SEQ ID NO: 419738 - DNA, 37 bp, Artificial Sequence; identical to SEQ ID NO: 71726
  Description of Artificial Sequence: Synthetic oligonucleotide

SEQ ID NO: 419739 - DNA, 37 bp, Artificial Sequence; identical to SEQ ID NO: 71727
  Description of Artificial Sequence: Synthetic oligonucleotide

SEQ ID NO: 419740 - DNA, 36 bp, Artificial Sequence; identical to SEQ ID NO: 71728
  Description of Artificial Sequence: Synthetic oligonucleotide

SEQ ID NO: 419741 - DNA, 35 bp, Artificial Sequence; identical to SEQ ID NO: 71729
  Description of Artificial Sequence: Synthetic oligonucleotide

SEQ ID NO: 419742 - DNA, 36 bp, Artificial Sequence; identical to SEQ ID NO: 71730
  Description of Artificial Sequence: Synthetic oligonucleotide

SEQ ID NO: 419743 - DNA, 36 bp, Artificial Sequence; identical to SEQ ID NO: 71731
  Description of Artificial Sequence: Synthetic oligonucleotide

SEQ ID NO: 419744 - DNA, 35 bp, Artificial Sequence; identical to SEQ ID NO: 71732
  Description of Artificial Sequence: Synthetic oligonucleotide

SEQ ID NO: 419745 - DNA, 35 bp, Artificial Sequence; identical to SEQ ID NO: 71733
  Description of Artificial Sequence: Synthetic oligonucleotide

SEQ ID NO: 419746 - DNA, 35 bp, Artificial Sequence; identical to SEQ ID NO: 71734
  Description of Artificial Sequence: Synthetic oligonucleotide

SEQ ID NO: 419747 - DNA, 34 bp, Artificial Sequence; identical to SEQ ID NO: 71735
  Description of Artificial Sequence: Synthetic oligonucleotide

SEQ ID NO: 419748 - DNA, 33 bp, Artificial Sequence; identical to SEQ ID NO: 71736
  Description of Artificial Sequence: Synthetic oligonucleotide

SEQ ID NO: 419749 - DNA, 33 bp, Artificial Sequence; identical to SEQ ID NO: 71737
  Description of Artificial Sequence: Synthetic oligonucleotide

SEQ ID NO: 419750 - DNA, 32 bp, Artificial Sequence; identical to SEQ ID NO: 71738
  Description of Artificial Sequence: Synthetic oligonucleotide

SEQ ID NO: 419751 - DNA, 33 bp, Artificial Sequence; identical to SEQ ID NO: 71739
  Description of Artificial Sequence: Synthetic oligonucleotide

SEQ ID NO: 419752 - DNA, 33 bp, Artificial Sequence; identical to SEQ ID NO: 71740
  Description of Artificial Sequence: Synthetic oligonucleotide

SEQ ID NO: 419753 - DNA, 32 bp, Artificial Sequence; identical to SEQ ID NO: 71741
  Description of Artificial Sequence: Synthetic oligonucleotide

SEQ ID NO: 419754 - DNA, 32 bp, Artificial Sequence; identical to SEQ ID NO: 71742
  Description of Artificial Sequence: Synthetic oligonucleotide

SEQ ID NO: 419755 - DNA, 31 bp, Artificial Sequence; identical to SEQ ID NO: 71743
  Description of Artificial Sequence: Synthetic oligonucleotide

SEQ ID NO: 419756 - DNA, 31 bp, Artificial Sequence; identical to SEQ ID NO: 71744
  Description of Artificial Sequence: Synthetic oligonucleotide

SEQ ID NO: 419757 - DNA, 30 bp, Artificial Sequence; identical to SEQ ID NO: 71745
  Description of Artificial Sequence: Synthetic oligonucleotide

SEQ ID NO: 419758 - DNA, 29 bp, Artificial Sequence
  Description of Artificial Sequence: Synthetic oligonucleotide
acttccataaccaggaggagatcgtgcgc

SEQ ID NO: 419759 - DNA, 28 bp, Artificial Sequence
  Description of Artificial Sequence: Synthetic oligonucleotide
cttccataaccaggaggagatcgtgcgc

SEQ ID NO: 419760 - DNA, 30 bp, Artificial Sequence; identical to SEQ ID NO: 71748
  Description of Artificial Sequence: Synthetic oligonucleotide

SEQ ID NO: 419761 - DNA, 29 bp, Artificial Sequence
  Description of Artificial Sequence: Synthetic oligonucleotide
tccataaccaggaggagatcgtgcgcttc

SEQ ID NO: 419762 - DNA, 28 bp, Artificial Sequence
  Description of Artificial Sequence: Synthetic oligonucleotide
ccataaccaggaggagatcgtgcgcttc

SEQ ID NO: 419763 - DNA, 28 bp, Artificial Sequence
  Description of Artificial Sequence: Synthetic oligonucleotide
cataaccaggaggagatcgtgcgcttcg

SEQ ID NO: 419764 - DNA, 29 bp, Artificial Sequence
  Description of Artificial Sequence: Synthetic oligonucleotide
ataaccaggaggagatcgtgcgcttcgac

SEQ ID NO: 419765 - DNA, 28 bp, Artificial Sequence
  Description of Artificial Sequence: Synthetic oligonucleotide
taaccaggaggagatcgtgcgcttcgac

SEQ ID NO: 419766 - DNA, 27 bp, Artificial Sequence
  Description of Artificial Sequence: Synthetic oligonucleotide
aaccaggaggagatcgtgcgcttcgac

SEQ ID NO: 419767 - DNA, 27 bp, Artificial Sequence
  Description of Artificial Sequence: Synthetic oligonucleotide
accaggaggagatcgtgcgcttcgaca

SEQ ID NO: 419768 - DNA, 26 bp, Artificial Sequence
  Description of Artificial Sequence: Synthetic oligonucleotide
ccaggaggagatcgtgcgcttcgaca

SEQ ID NO: 419769 - DNA, 26 bp, Artificial Sequence
  Description of Artificial Sequence: Synthetic oligonucleotide
caggaggagatcgtgcgcttcgacag

SEQ ID NO: 419770 - DNA, 26 bp, Artificial Sequence
  Description of Artificial Sequence: Synthetic oligonucleotide
aggaggagatcgtgcgcttcgacagc

SEQ ID NO: 419771 - DNA, 25 bp, Artificial Sequence
  Description of Artificial Sequence: Synthetic oligonucleotide
ggaggagatcgtgcgcttcgacagc

SEQ ID NO: 419772 - DNA, 26 bp, Artificial Sequence
  Description of Artificial Sequence: Synthetic oligonucleotide
gaggagatcgtgcgcttcgacagcga

SEQ ID NO: 419773 - DNA, 26 bp, Artificial Sequence
  Description of Artificial Sequence: Synthetic oligonucleotide
aggagatcgtgcgcttcgacagcgac

SEQ ID NO: 419774 - DNA, 25 bp, Artificial Sequence
  Description of Artificial Sequence: Synthetic oligonucleotide
ggagatcgtgcgcttcgacagcgac

SEQ ID NO: 419775 - DNA, 30 bp, Artificial Sequence; identical to SEQ ID NO: 71763
  Description of Artificial Sequence: Synthetic oligonucleotide

SEQ ID NO: 419776 - DNA, 29 bp, Artificial Sequence
  Description of Artificial Sequence: Synthetic oligonucleotide
acagccagaaggacctcctggaagacaag

SEQ ID NO: 419777 - DNA, 28 bp, Artificial Sequence
  Description of Artificial Sequence: Synthetic oligonucleotide
cagccagaaggacctcctggaagacaag

SEQ ID NO: 419778 - DNA, 28 bp, Artificial Sequence
  Description of Artificial Sequence: Synthetic oligonucleotide
agccagaaggacctcctggaagacaagc

SEQ ID NO: 419779 - DNA, 27 bp, Artificial Sequence
  Description of Artificial Sequence: Synthetic oligonucleotide
gccagaaggacctcctggaagacaagc

SEQ ID NO: 419780 - DNA, 27 bp, Artificial Sequence
  Description of Artificial Sequence: Synthetic oligonucleotide
ccagaaggacctcctggaagacaagcg

SEQ ID NO: 419781 - DNA, 27 bp, Artificial Sequence
  Description of Artificial Sequence: Synthetic oligonucleotide
cagaaggacctcctggaagacaagcgg

SEQ ID NO: 419782 - DNA, 27 bp, Artificial Sequence
  Description of Artificial Sequence: Synthetic oligonucleotide
agaaggacctcctggaagacaagcggg

SEQ ID NO: 419783 - DNA, 26 bp, Artificial Sequence
  Description of Artificial Sequence: Synthetic oligonucleotide
gaaggacctcctggaagacaagcggg

SEQ ID NO: 419784 - DNA, 26 bp, Artificial Sequence
  Description of Artificial Sequence: Synthetic oligonucleotide
aaggacctcctggaagacaagcgggc

SEQ ID NO: 419785 - DNA, 25 bp, Artificial Sequence
  Description of Artificial Sequence: Synthetic oligonucleotide
aggacctcctggaagacaagcgggc

SEQ ID NO: 419786 - DNA, 24 bp, Artificial Sequence
  Description of Artificial Sequence: Synthetic oligonucleotide
ggacctcctggaagacaagcgggc

SEQ ID NO: 419787 - DNA, 24 bp, Artificial Sequence
  Description of Artificial Sequence: Synthetic oligonucleotide
gacctcctggaagacaagcgggcc

SEQ ID NO: 419788 - DNA, 24 bp, Artificial Sequence
  Description of Artificial Sequence: Synthetic oligonucleotide
acctcctggaagacaagcgggccg

SEQ ID NO: 419789 - DNA, 23 bp, Artificial Sequence
  Description of Artificial Sequence: Synthetic oligonucleotide
cctcctggaagacaagcgggccg

SEQ ID NO: 419790 - DNA, 23 bp, Artificial Sequence
  Description of Artificial Sequence: Synthetic oligonucleotide
ctcctggaagacaagcgggccgc

SEQ ID NO: 419791 - DNA, 23 bp, Artificial Sequence
  Description of Artificial Sequence: Synthetic oligonucleotide
ggtgacggagctggggcggctta

SEQ ID NO: 419792 - DNA, 23 bp, Artificial Sequence
  Description of Artificial Sequence: Synthetic oligonucleotide
gtgacggagctggggcggcttag

SEQ ID NO: 419793 - DNA, 23 bp, Artificial Sequence
  Description of Artificial Sequence: Synthetic oligonucleotide
tgacggagctggggcggcttagc

SEQ ID NO: 419794 - DNA, 22 bp, Artificial Sequence
  Description of Artificial Sequence: Synthetic oligonucleotide
gacggagctggggcggcttagc

SEQ ID NO: 419795 - DNA, 22 bp, Artificial Sequence
  Description of Artificial Sequence: Synthetic oligonucleotide
acggagctggggcggcttagcg

SEQ ID NO: 419796 - DNA, 21 bp, Artificial Sequence
  Description of Artificial Sequence: Synthetic oligonucleotide
cggagctggggcggcttagcg

SEQ ID NO: 419797 - DNA, 21 bp, Artificial Sequence
  Description of Artificial Sequence: Synthetic oligonucleotide
ggagctggggcggcttagcgc

SEQ ID NO: 419798 - DNA, 21 bp, Artificial Sequence
  Description of Artificial Sequence: Synthetic oligonucleotide
gagctggggcggcttagcgcc

SEQ ID NO: 419799 - DNA, 22 bp, Artificial Sequence
  Description of Artificial Sequence: Synthetic oligonucleotide
agctggggcggcttagcgccga

SEQ ID NO: 419800 - DNA, 21 bp, Artificial Sequence
  Description of Artificial Sequence: Synthetic oligonucleotide
gctggggcggcttagcgccga

SEQ ID NO: 419801 - DNA, 23 bp, Artificial Sequence
  Description of Artificial Sequence: Synthetic oligonucleotide
ctggggcggcttagcgccgagta

SEQ ID NO: 419802 - DNA, 24 bp, Artificial Sequence
  Description of Artificial Sequence: Synthetic oligonucleotide
tggggcggcttagcgccgagtact

SEQ ID NO: 419803 - DNA, 23 bp, Artificial Sequence
  Description of Artificial Sequence: Synthetic oligonucleotide
ggggcggcttagcgccgagtact

SEQ ID NO: 419804 - DNA, 23 bp, Artificial Sequence
  Description of Artificial Sequence: Synthetic oligonucleotide
gggcggcttagcgccgagtactg

SEQ ID NO: 419805 - DNA, 25 bp, Artificial Sequence
  Description of Artificial Sequence: Synthetic oligonucleotide
ggcggcttagcgccgagtactggaa

SEQ ID NO: 419806 - DNA, 26 bp, Artificial Sequence
  Description of Artificial Sequence: Synthetic oligonucleotide
gcggcttagcgccgagtactggaaca

SEQ ID NO: 419807 - DNA, 26 bp, Artificial Sequence
  Description of Artificial Sequence: Synthetic oligonucleotide
cggcttagcgccgagtactggaacag

SEQ ID NO: 419808 - DNA, 26 bp, Artificial Sequence
  Description of Artificial Sequence: Synthetic oligonucleotide
ggcttagcgccgagtactggaacagc

SEQ ID NO: 419809 - DNA, 27 bp, Artificial Sequence
  Description of Artificial Sequence: Synthetic oligonucleotide
gcttagcgccgagtactggaacagcca

SEQ ID NO: 419810 - DNA, 27 bp, Artificial Sequence
  Description of Artificial Sequence: Synthetic oligonucleotide
cttagcgccgagtactggaacagccag

SEQ ID NO: 419811 - DNA, 29 bp, Artificial Sequence
  Description of Artificial Sequence: Synthetic oligonucleotide
ttagcgccgagtactggaacagccagaag

SEQ ID NO: 419812 - DNA, 34 bp, Artificial Sequence; identical to SEQ ID NO: 71800
  Description of Artificial Sequence: Synthetic oligonucleotide

SEQ ID NO: 419813 - DNA, 33 bp, Artificial Sequence; identical to SEQ ID NO: 71801
  Description of Artificial Sequence: Synthetic oligonucleotide

SEQ ID NO: 419814 - DNA, 33 bp, Artificial Sequence; identical to SEQ ID NO: 71802
  Description of Artificial Sequence: Synthetic oligonucleotide

SEQ ID NO: 419815 - DNA, 32 bp, Artificial Sequence; identical to SEQ ID NO: 71803
  Description of Artificial Sequence: Synthetic oligonucleotide

SEQ ID NO: 419816 - DNA, 34 bp, Artificial Sequence; identical to SEQ ID NO: 71804
  Description of Artificial Sequence: Synthetic oligonucleotide

SEQ ID NO: 419817 - DNA, 33 bp, Artificial Sequence; identical to SEQ ID NO: 71805
  Description of Artificial Sequence: Synthetic oligonucleotide

SEQ ID NO: 419818 - DNA, 32 bp, Artificial Sequence; identical to SEQ ID NO: 71806
  Description of Artificial Sequence: Synthetic oligonucleotide

SEQ ID NO: 419819 - DNA, 31 bp, Artificial Sequence; identical to SEQ ID NO: 71807
  Description of Artificial Sequence: Synthetic oligonucleotide

SEQ ID NO: 419820 - DNA, 31 bp, Artificial Sequence; identical to SEQ ID NO: 71808
  Description of Artificial Sequence: Synthetic oligonucleotide

SEQ ID NO: 419821 - DNA, 30 bp, Artificial Sequence; identical to SEQ ID NO: 71809
  Description of Artificial Sequence: Synthetic oligonucleotide

SEQ ID NO: 419822 - DNA, 29 bp, Artificial Sequence
  Description of Artificial Sequence: Synthetic oligonucleotide
ccataaccaggaggagaacgtgtgcttcg

SEQ ID NO: 419823 - DNA, 30 bp, Artificial Sequence; identical to SEQ ID NO: 71811
  Description of Artificial Sequence: Synthetic oligonucleotide

SEQ ID NO: 419824 - DNA, 31 bp, Artificial Sequence; identical to SEQ ID NO: 71812
  Description of Artificial Sequence: Synthetic oligonucleotide

SEQ ID NO: 419825 - DNA, 30 bp, Artificial Sequence; identical to SEQ ID NO: 71813
  Description of Artificial Sequence: Synthetic oligonucleotide

SEQ ID NO: 419826 - DNA, 29 bp, Artificial Sequence
  Description of Artificial Sequence: Synthetic oligonucleotide
aaccaggaggagaacgtgtgcttcgacag

SEQ ID NO: 419827 - DNA, 28 bp, Artificial Sequence
  Description of Artificial Sequence: Synthetic oligonucleotide
accaggaggagaacgtgtgcttcgacag

SEQ ID NO: 419828 - DNA, 27 bp, Artificial Sequence
  Description of Artificial Sequence: Synthetic oligonucleotide
ccaggaggagaacgtgtgcttcgacag

SEQ ID NO: 419829 - DNA, 27 bp, Artificial Sequence
  Description of Artificial Sequence: Synthetic oligonucleotide
caggaggagaacgtgtgcttcgacagc

SEQ ID NO: 419830 - DNA, 27 bp, Artificial Sequence
  Description of Artificial Sequence: Synthetic oligonucleotide
aggaggagaacgtgtgcttcgacagcg

SEQ ID NO: 419831 - DNA, 27 bp, Artificial Sequence
  Description of Artificial Sequence: Synthetic oligonucleotide
ggaggagaacgtgtgcttcgacagcga

SEQ ID NO: 419832 - DNA, 27 bp, Artificial Sequence
  Description of Artificial Sequence: Synthetic oligonucleotide
gaggagaacgtgtgcttcgacagcgac

SEQ ID NO: 419833 - DNA, 27 bp, Artificial Sequence
  Description of Artificial Sequence: Synthetic oligonucleotide
aggagaacgtgtgcttcgacagcgacg

SEQ ID NO: 419834 - DNA, 27 bp, Artificial Sequence
  Description of Artificial Sequence: Synthetic oligonucleotide
ggagaacgtgtgcttcgacagcgacgt

SEQ ID NO: 419835 - DNA, 27 bp, Artificial Sequence
  Description of Artificial Sequence: Synthetic oligonucleotide
gagaacgtgtgcttcgacagcgacgtg

SEQ ID NO: 419836 - DNA, 27 bp, Artificial Sequence
  Description of Artificial Sequence: Synthetic oligonucleotide
agaacgtgtgcttcgacagcgacgtgg

SEQ ID NO: 419837 - DNA, 26 bp, Artificial Sequence
  Description of Artificial Sequence: Synthetic oligonucleotide
gaacgtgtgcttcgacagcgacgtgg

SEQ ID NO: 419838 - DNA, 26 bp, Artificial Sequence
  Description of Artificial Sequence: Synthetic oligonucleotide
aacgtgtgcttcgacagcgacgtggg

SEQ ID NO: 419839 - DNA, 25 bp, Artificial Sequence
  Description of Artificial Sequence: Synthetic oligonucleotide
acgtgtgcttcgacagcgacgtggg

SEQ ID NO: 419840 - DNA, 24 bp, Artificial Sequence
  Description of Artificial Sequence: Synthetic oligonucleotide
cgtgtgcttcgacagcgacgtggg

SEQ ID NO: 419841 - DNA, 24 bp, Artificial Sequence
  Description of Artificial Sequence: Synthetic oligonucleotide
gtgtgcttcgacagcgacgtgggg

SEQ ID NO: 419842 - DNA, 25 bp, Artificial Sequence
  Description of Artificial Sequence: Synthetic oligonucleotide
tgtgcttcgacagcgacgtggggga

SEQ ID NO: 419843 - DNA, 24 bp, Artificial Sequence
  Description of Artificial Sequence: Synthetic oligonucleotide
gtgcttcgacagcgacgtggggga

SEQ ID NO: 419844 - DNA, 26 bp, Artificial Sequence
  Description of Artificial Sequence: Synthetic oligonucleotide
tgcttcgacagcgacgtgggggagtt

SEQ ID NO: 419845 - DNA, 27 bp, Artificial Sequence
  Description of Artificial Sequence: Synthetic oligonucleotide
cttcaatgggacggagcgggtgcagtt

SEQ ID NO: 419846 - DNA, 27 bp, Artificial Sequence
  Description of Artificial Sequence: Synthetic oligonucleotide
ttcaatgggacggagcgggtgcagttc

SEQ ID NO: 419847 - DNA, 26 bp, Artificial Sequence
  Description of Artificial Sequence: Synthetic oligonucleotide
tcaatgggacggagcgggtgcagttc

SEQ ID NO: 419848 - DNA, 25 bp, Artificial Sequence
  Description of Artificial Sequence: Synthetic oligonucleotide
caatgggacggagcgggtgcagttc

SEQ ID NO: 419849 - DNA, 26 bp, Artificial Sequence
  Description of Artificial Sequence: Synthetic oligonucleotide
aatgggacggagcgggtgcagttcct

SEQ ID NO: 419850 - DNA, 25 bp, Artificial Sequence
  Description of Artificial Sequence: Synthetic oligonucleotide
atgggacggagcgggtgcagttcct

SEQ ID NO: 419851 - DNA, 24 bp, Artificial Sequence
  Description of Artificial Sequence: Synthetic oligonucleotide
tgggacggagcgggtgcagttcct

SEQ ID NO: 419852 - DNA, 24 bp, Artificial Sequence
  Description of Artificial Sequence: Synthetic oligonucleotide
gacggagcgggtgcagttcctgga

SEQ ID NO: 419853 - DNA, 25 bp, Artificial Sequence
  Description of Artificial Sequence: Synthetic oligonucleotide
acggagcgggtgcagttcctggaca

SEQ ID NO: 419854 - DNA, 24 bp, Artificial Sequence
  Description of Artificial Sequence: Synthetic oligonucleotide
cggagcgggtgcagttcctggaca

SEQ ID NO: 419855 - DNA, 27 bp, Artificial Sequence
  Description of Artificial Sequence: Synthetic oligonucleotide
ggagcgggtgcagttcctggacagata

SEQ ID NO: 419856 - DNA, 27 bp, Artificial Sequence
  Description of Artificial Sequence: Synthetic oligonucleotide
gagcgggtgcagttcctggacagatac

SEQ ID NO: 419857 - DNA, 29 bp, Artificial Sequence
  Description of Artificial Sequence: Synthetic oligonucleotide
agcgggtgcagttcctggacagatacttc

SEQ ID NO: 419858 - DNA, 28 bp, Artificial Sequence
  Description of Artificial Sequence: Synthetic oligonucleotide
gcgggtgcagttcctggacagatacttc

SEQ ID NO: 419859 - DNA, 28 bp, Artificial Sequence
  Description of Artificial Sequence: Synthetic oligonucleotide
cgggtgcagttcctggacagatacttcc

SEQ ID NO: 419860 - DNA, 32 bp, Artificial Sequence; identical to SEQ ID NO: 71848
  Description of Artificial Sequence: Synthetic oligonucleotide

SEQ ID NO: 419861 - DNA, 32 bp, Artificial Sequence; identical to SEQ ID NO: 71849
  Description of Artificial Sequence: Synthetic oligonucleotide

SEQ ID NO: 419862 - DNA, 33 bp, Artificial Sequence; identical to SEQ ID NO: 71850
  Description of Artificial Sequence: Synthetic oligonucleotide

SEQ ID NO: 419863 - DNA, 33 bp, Artificial Sequence; identical to SEQ ID NO: 71851
  Description of Artificial Sequence: Synthetic oligonucleotide

SEQ ID NO: 419864 - DNA, 32 bp, Artificial Sequence; identical to SEQ ID NO: 71852
  Description of Artificial Sequence: Synthetic oligonucleotide

SEQ ID NO: 419865 - DNA, 33 bp, Artificial Sequence; identical to SEQ ID NO: 71853
  Description of Artificial Sequence: Synthetic oligonucleotide

SEQ ID NO: 419866 - DNA, 33 bp, Artificial Sequence; identical to SEQ ID NO: 71854
  Description of Artificial Sequence: Synthetic oligonucleotide

SEQ ID NO: 419867 - DNA, 29 bp, Artificial Sequence
  Description of Artificial Sequence: Synthetic oligonucleotide
aagaggagtacgtgcgcttcgacagctac

SEQ ID NO: 419868 - DNA, 28 bp, Artificial Sequence
  Description of Artificial Sequence: Synthetic oligonucleotide
agaggagtacgtgcgcttcgacagctac

SEQ ID NO: 419869 - DNA, 27 bp, Artificial Sequence
  Description of Artificial Sequence: Synthetic oligonucleotide
gaggagtacgtgcgcttcgacagctac

SEQ ID NO: 419870 - DNA, 27 bp, Artificial Sequence
  Description of Artificial Sequence: Synthetic oligonucleotide
aggagtacgtgcgcttcgacagctacg

SEQ ID NO: 419871 - DNA, 27 bp, Artificial Sequence
  Description of Artificial Sequence: Synthetic oligonucleotide
ggagtacgtgcgcttcgacagctacgt

SEQ ID NO: 419872 - DNA, 27 bp, Artificial Sequence
  Description of Artificial Sequence: Synthetic oligonucleotide
gagtacgtgcgcttcgacagctacgtg

SEQ ID NO: 419873 - DNA, 27 bp, Artificial Sequence
  Description of Artificial Sequence: Synthetic oligonucleotide
agtacgtgcgcttcgacagctacgtgg

SEQ ID NO: 419874 - DNA, 26 bp, Artificial Sequence
  Description of Artificial Sequence: Synthetic oligonucleotide
gtacgtgcgcttcgacagctacgtgg

SEQ ID NO: 419875 - DNA, 26 bp, Artificial Sequence
  Description of Artificial Sequence: Synthetic oligonucleotide
tacgtgcgcttcgacagctacgtggg

SEQ ID NO: 419876 - DNA, 25 bp, Artificial Sequence
  Description of Artificial Sequence: Synthetic oligonucleotide
acgtgcgcttcgacagctacgtggg

SEQ ID NO: 419877 - DNA, 24 bp, Artificial Sequence
  Description of Artificial Sequence: Synthetic oligonucleotide
cgtgcgcttcgacagctacgtggg

SEQ ID NO: 419878 - DNA, 24 bp, Artificial Sequence
  Description of Artificial Sequence: Synthetic oligonucleotide
gtgcgcttcgacagctacgtgggg

SEQ ID NO: 419879 - DNA, 25 bp, Artificial Sequence
  Description of Artificial Sequence: Synthetic oligonucleotide
tgcgcttcgacagctacgtggggga

SEQ ID NO: 419880 - DNA, 24 bp, Artificial Sequence
  Description of Artificial Sequence: Synthetic oligonucleotide
gcgcttcgacagctacgtggggga

SEQ ID NO: 419881 - DNA, 26 bp, Artificial Sequence
  Description of Artificial Sequence: Synthetic oligonucleotide
cgcttcgacagctacgtgggggagta

SEQ ID NO: 419882 - DNA, 26 bp, Artificial Sequence
  Description of Artificial Sequence: Synthetic oligonucleotide
gcttcgacagctacgtgggggagtac

SEQ ID NO: 419883 - DNA, 26 bp, Artificial Sequence
  Description of Artificial Sequence: Synthetic oligonucleotide
cttcgacagctacgtgggggagtacc

SEQ ID NO: 419884 - DNA, 26 bp, Artificial Sequence
  Description of Artificial Sequence: Synthetic oligonucleotide
ttcgacagctacgtgggggagtaccg

SEQ ID NO: 419885 - DNA, 25 bp, Artificial Sequence
  Description of Artificial Sequence: Synthetic oligonucleotide
tcgacagctacgtgggggagtaccg

SEQ ID NO: 419886 - DNA, 24 bp, Artificial Sequence
  Description of Artificial Sequence: Synthetic oligonucleotide
cgacagctacgtgggggagtaccg

SEQ ID NO: 419887 - DNA, 24 bp, Artificial Sequence
  Description of Artificial Sequence: Synthetic oligonucleotide
gacagctacgtgggggagtaccgg

SEQ ID NO: 419888 - DNA, 24 bp, Artificial Sequence
  Description of Artificial Sequence: Synthetic oligonucleotide
acagctacgtgggggagtaccggg

SEQ ID NO: 419889 - DNA, 23 bp, Artificial Sequence
  Description of Artificial Sequence: Synthetic oligonucleotide
cagctacgtgggggagtaccggg

SEQ ID NO: 419890 - DNA, 23 bp, Artificial Sequence
  Description of Artificial Sequence: Synthetic oligonucleotide
agctacgtgggggagtaccgggc

SEQ ID NO: 419891 - DNA, 22 bp, Artificial Sequence
  Description of Artificial Sequence: Synthetic oligonucleotide
gctacgtgggggagtaccgggc

SEQ ID NO: 419892 - DNA, 22 bp, Artificial Sequence
  Description of Artificial Sequence: Synthetic oligonucleotide
ctacgtgggggagtaccgggcg

SEQ ID NO: 419893 - DNA, 23 bp, Artificial Sequence
  Description of Artificial Sequence: Synthetic oligonucleotide
tacgtgggggagtaccgggcggt

SEQ ID NO: 419894 - DNA, 32 bp, Artificial Sequence; identical to SEQ ID NO: 71885
  Description of Artificial Sequence: Synthetic oligonucleotide

SEQ ID NO: 419895 - DNA, 31 bp, Artificial Sequence; identical to SEQ ID NO: 71886
  Description of Artificial Sequence: Synthetic oligonucleotide

SEQ ID NO: 419896 - DNA, 31 bp, Artificial Sequence; identical to SEQ ID NO: 71887
  Description of Artificial Sequence: Synthetic oligonucleotide

SEQ ID NO: 419897 - DNA, 30 bp, Artificial Sequence; identical to SEQ ID NO: 71888
  Description of Artificial Sequence: Synthetic oligonucleotide

SEQ ID NO: 419898 - DNA, 31 bp, Artificial Sequence; identical to SEQ ID NO: 71889
  Description of Artificial Sequence: Synthetic oligonucleotide

SEQ ID NO: 419899 - DNA, 32 bp, Artificial Sequence; identical to SEQ ID NO: 71890
  Description of Artificial Sequence: Synthetic oligonucleotide

SEQ ID NO: 419900 - DNA, 31 bp, Artificial Sequence; identical to SEQ ID NO: 71891
  Description of Artificial Sequence: Synthetic oligonucleotide

SEQ ID NO: 419901 - DNA, 30 bp, Artificial Sequence; identical to SEQ ID NO: 71892
  Description of Artificial Sequence: Synthetic oligonucleotide

SEQ ID NO: 419902 - DNA, 30 bp, Artificial Sequence; identical to SEQ ID NO: 71893
  Description of Artificial Sequence: Synthetic oligonucleotide

SEQ ID NO: 419903 - DNA, 29 bp, Artificial Sequence
  Description of Artificial Sequence: Synthetic oligonucleotide
gcagacacaactacggggttatggagagc

SEQ ID NO: 419904 - DNA, 31 bp, Artificial Sequence; identical to SEQ ID NO: 71895
  Description of Artificial Sequence: Synthetic oligonucleotide

SEQ ID NO: 419905 - DNA, 32 bp, Artificial Sequence; identical to SEQ ID NO: 71896
  Description of Artificial Sequence: Synthetic oligonucleotide

SEQ ID NO: 419906 - DNA, 31 bp, Artificial Sequence; identical to SEQ ID NO: 71897
  Description of Artificial Sequence: Synthetic oligonucleotide

SEQ ID NO: 419907 - DNA, 32 bp, Artificial Sequence; identical to SEQ ID NO: 71898
  Description of Artificial Sequence: Synthetic oligonucleotide

SEQ ID NO: 419908 - DNA, 31 bp, Artificial Sequence; identical to SEQ ID NO: 71899
  Description of Artificial Sequence: Synthetic oligonucleotide

SEQ ID NO: 419909 - DNA, 32 bp, Artificial Sequence; identical to SEQ ID NO: 71900
  Description of Artificial Sequence: Synthetic oligonucleotide

SEQ ID NO: 419910 - DNA, 31 bp, Artificial Sequence; identical to SEQ ID NO: 71901
  Description of Artificial Sequence: Synthetic oligonucleotide

SEQ ID NO: 419911 - DNA, 31 bp, Artificial Sequence; identical to SEQ ID NO: 71902
  Description of Artificial Sequence: Synthetic oligonucleotide

SEQ ID NO: 419912 - DNA, 30 bp, Artificial Sequence; identical to SEQ ID NO: 71903
  Description of Artificial Sequence: Synthetic oligonucleotide

SEQ ID NO: 419913 - DNA, 29 bp, Artificial Sequence
  Description of Artificial Sequence: Synthetic oligonucleotide
ctacggggttatggagagcttcacagtgc

SEQ ID NO: 419914 - DNA, 30 bp, Artificial Sequence; identical to SEQ ID NO: 71905
  Description of Artificial Sequence: Synthetic oligonucleotide

SEQ ID NO: 419915 - DNA, 29 bp, Artificial Sequence
  Description of Artificial Sequence: Synthetic oligonucleotide
acggggttatggagagcttcacagtgcag

SEQ ID NO: 419916 - DNA, 28 bp, Artificial Sequence
  Description of Artificial Sequence: Synthetic oligonucleotide
cggggttatggagagcttcacagtgcag

SEQ ID NO: 419917 - DNA, 28 bp, Artificial Sequence
  Description of Artificial Sequence: Synthetic oligonucleotide
ggggttatggagagcttcacagtgcagc

SEQ ID NO: 419918 - DNA, 28 bp, Artificial Sequence
  Description of Artificial Sequence: Synthetic oligonucleotide
gggttatggagagcttcacagtgcagcg

SEQ ID NO: 419919 - DNA, 28 bp, Artificial Sequence
  Description of Artificial Sequence: Synthetic oligonucleotide
ggttatggagagcttcacagtgcagcgg

SEQ ID NO: 419920 - DNA, 28 bp, Artificial Sequence
  Description of Artificial Sequence: Synthetic oligonucleotide
gttatggagagcttcacagtgcagcggc

SEQ ID NO: 419921 - DNA, 28 bp, Artificial Sequence
  Description of Artificial Sequence: Synthetic oligonucleotide
ttatggagagcttcacagtgcagcggcg

SEQ ID NO: 419922 - DNA, 27 bp, Artificial Sequence
  Description of Artificial Sequence: Synthetic oligonucleotide
tatggagagcttcacagtgcagcggcg

SEQ ID NO: 419923 - DNA, 27 bp, Artificial Sequence
  Description of Artificial Sequence: Synthetic oligonucleotide
atggagagcttcacagtgcagcggcga

SEQ ID NO: 419924 - DNA, 23 bp, Artificial Sequence
  Description of Artificial Sequence: Synthetic oligonucleotide
gtgggggagttccgggcggtgaa

SEQ ID NO: 419925 - DNA, 23 bp, Artificial Sequence
  Description of Artificial Sequence: Synthetic oligonucleotide
tgggggagttccgggcggtgaag

SEQ ID NO: 419926 - DNA, 22 bp, Artificial Sequence
  Description of Artificial Sequence: Synthetic oligonucleotide
gggggagttccgggcggtgaag

SEQ ID NO: 419927 - DNA, 23 bp, Artificial Sequence
  Description of Artificial Sequence: Synthetic oligonucleotide
ggggagttccgggcggtgaagga

SEQ ID NO: 419928 - DNA, 23 bp, Artificial Sequence
  Description of Artificial Sequence: Synthetic oligonucleotide
gggagttccgggcggtgaaggag

SEQ ID NO: 419929 - DNA, 24 bp, Artificial Sequence
  Description of Artificial Sequence: Synthetic oligonucleotide
ggagttccgggcggtgaaggagct

SEQ ID NO: 419930 - DNA, 24 bp, Artificial Sequence
  Description of Artificial Sequence: Synthetic oligonucleotide
gagttccgggcggtgaaggagctg

SEQ ID NO: 419931 - DNA, 24 bp, Artificial Sequence
  Description of Artificial Sequence: Synthetic oligonucleotide
agttccgggcggtgaaggagctgg

SEQ ID NO: 419932 - DNA, 23 bp, Artificial Sequence
  Description of Artificial Sequence: Synthetic oligonucleotide
gttccgggcggtgaaggagctgg

SEQ ID NO: 419933 - DNA, 23 bp, Artificial Sequence
  Description of Artificial Sequence: Synthetic oligonucleotide
ttccgggcggtgaaggagctggg

SEQ ID NO: 419934 - DNA, 22 bp, Artificial Sequence
  Description of Artificial Sequence: Synthetic oligonucleotide
tccgggcggtgaaggagctggg

SEQ ID NO: 419935 - DNA, 21 bp, Artificial Sequence
  Description of Artificial Sequence: Synthetic oligonucleotide
ccgggcggtgaaggagctggg

SEQ ID NO: 419936 - DNA, 21 bp, Artificial Sequence
  Description of Artificial Sequence: Synthetic oligonucleotide
cgggcggtgaaggagctgggg

SEQ ID NO: 419937 - DNA, 21 bp, Artificial Sequence
  Description of Artificial Sequence: Synthetic oligonucleotide
gggcggtgaaggagctggggc

SEQ ID NO: 419938 - DNA, 21 bp, Artificial Sequence
  Description of Artificial Sequence: Synthetic oligonucleotide
ggcggtgaaggagctggggcg

SEQ ID NO: 419939 - DNA, 21 bp, Artificial Sequence
  Description of Artificial Sequence: Synthetic oligonucleotide
gcggtgaaggagctggggcgg

SEQ ID NO: 419940 - DNA, 21 bp, Artificial Sequence
  Description of Artificial Sequence: Synthetic oligonucleotide
cggtgaaggagctggggcggc

SEQ ID NO: 419941 - DNA, 22 bp, Artificial Sequence
  Description of Artificial Sequence: Synthetic oligonucleotide
ggtgaaggagctggggcggcct

SEQ ID NO: 419942 - DNA, 24 bp, Artificial Sequence
  Description of Artificial Sequence: Synthetic oligonucleotide
gtgaaggagctggggcggcctgat

SEQ ID NO: 419943 - DNA, 24 bp, Artificial Sequence
  Description of Artificial Sequence: Synthetic oligonucleotide
tgaaggagctggggcggcctgatg

SEQ ID NO: 419944 - DNA, 23 bp, Artificial Sequence
  Description of Artificial Sequence: Synthetic oligonucleotide
gaaggagctggggcggcctgatg

SEQ ID NO: 419945 - DNA, 23 bp, Artificial Sequence
  Description of Artificial Sequence: Synthetic oligonucleotide
aaggagctggggcggcctgatgc

SEQ ID NO: 419946 - DNA, 22 bp, Artificial Sequence
  Description of Artificial Sequence: Synthetic oligonucleotide
aggagctggggcggcctgatgc

SEQ ID NO: 419947 - DNA, 27 bp, Artificial Sequence
  Description of Artificial Sequence: Synthetic oligonucleotide
cttcaaagacccagcccctgcagcact

SEQ ID NO: 419948 - DNA, 28 bp, Artificial Sequence
  Description of Artificial Sequence: Synthetic oligonucleotide
ttcaaagacccagcccctgcagcactac

SEQ ID NO: 419949 - DNA, 27 bp, Artificial Sequence
  Description of Artificial Sequence: Synthetic oligonucleotide
tcaaagacccagcccctgcagcactac

SEQ ID NO: 419950 - DNA, 27 bp, Artificial Sequence
  Description of Artificial Sequence: Synthetic oligonucleotide
caaagacccagcccctgcagcactaca

SEQ ID NO: 419951 - DNA, 28 bp, Artificial Sequence
  Description of Artificial Sequence: Synthetic oligonucleotide
aaagacccagcccctgcagcactacaac

SEQ ID NO: 419952 - DNA, 27 bp, Artificial Sequence
  Description of Artificial Sequence: Synthetic oligonucleotide
aagacccagcccctgcagcactacaac

SEQ ID NO: 419953 - DNA, 26 bp, Artificial Sequence
  Description of Artificial Sequence: Synthetic oligonucleotide
agacccagcccctgcagcactacaac

SEQ ID NO: 419954 - DNA, 25 bp, Artificial Sequence
  Description of Artificial Sequence: Synthetic oligonucleotide
gacccagcccctgcagcactacaac

SEQ ID NO: 419955 - DNA, 26 bp, Artificial Sequence
  Description of Artificial Sequence: Synthetic oligonucleotide
acccagcccctgcagcactacaacct

SEQ ID NO: 419956 - DNA, 25 bp, Artificial Sequence
  Description of Artificial Sequence: Synthetic oligonucleotide
cccagcccctgcagcactacaacct

SEQ ID NO: 419957 - DNA, 25 bp, Artificial Sequence
  Description of Artificial Sequence: Synthetic oligonucleotide
ccagcccctgcagcactacaacctg

SEQ ID NO: 419958 - DNA, 26 bp, Artificial Sequence
  Description of Artificial Sequence: Synthetic oligonucleotide
cagcccctgcagcactacaacctgct

SEQ ID NO: 419959 - DNA, 26 bp, Artificial Sequence
  Description of Artificial Sequence: Synthetic oligonucleotide
agcccctgcagcactacaacctgctg

SEQ ID NO: 419960 - DNA, 25 bp, Artificial Sequence
  Description of Artificial Sequence: Synthetic oligonucleotide
gcccctgcagcactacaacctgctg

SEQ ID NO: 419961 - DNA, 26 bp, Artificial Sequence
  Description of Artificial Sequence: Synthetic oligonucleotide
cccctgcagcactacaacctgctggt

SEQ ID NO: 419962 - DNA, 27 bp, Artificial Sequence
  Description of Artificial Sequence: Synthetic oligonucleotide
ccctgcagcactacaacctgctggtct

SEQ ID NO: 419963 - DNA, 27 bp, Artificial Sequence
  Description of Artificial Sequence: Synthetic oligonucleotide
cctgcagcactacaacctgctggtctg

SEQ ID NO: 419964 - DNA, 29 bp, Artificial Sequence
  Description of Artificial Sequence: Synthetic oligonucleotide
ctgcagcactacaacctgctggtctgttc

SEQ ID NO: 419965 - DNA, 30 bp, Artificial Sequence; identical to SEQ ID NO: 71956
  Description of Artificial Sequence: Synthetic oligonucleotide

SEQ ID NO: 419966 - DNA, 29 bp, Artificial Sequence
  Description of Artificial Sequence: Synthetic oligonucleotide
gcagcactacaacctgctggtctgttctg

SEQ ID NO: 419967 - DNA, 30 bp, Artificial Sequence; identical to SEQ ID NO: 71958
  Description of Artificial Sequence: Synthetic oligonucleotide

SEQ ID NO: 419968 - DNA, 31 bp, Artificial Sequence; identical to SEQ ID NO: 71959
  Description of Artificial Sequence: Synthetic oligonucleotide

SEQ ID NO: 419969 - DNA, 30 bp, Artificial Sequence; identical to SEQ ID NO: 71960
  Description of Artificial Sequence: Synthetic oligonucleotide

SEQ ID NO: 419970 - DNA, 31 bp, Artificial Sequence; identical to SEQ ID NO: 71961
  Description of Artificial Sequence: Synthetic oligonucleotide

SEQ ID NO: 419971 - DNA, 31 bp, Artificial Sequence; identical to SEQ ID NO: 71962
  Description of Artificial Sequence: Synthetic oligonucleotide

SEQ ID NO: 419972 - DNA, 30 bp, Artificial Sequence; identical to SEQ ID NO: 71963
  Description of Artificial Sequence: Synthetic oligonucleotide

SEQ ID NO: 419973 - DNA, 33 bp, Artificial Sequence; identical to SEQ ID NO: 71964
  Description of Artificial Sequence: Synthetic oligonucleotide

SEQ ID NO: 419974 - DNA, 33 bp, Artificial Sequence; identical to SEQ ID NO: 71965
  Description of Artificial Sequence: Synthetic oligonucleotide

SEQ ID NO: 419975 - DNA, 34 bp, Artificial Sequence; identical to SEQ ID NO: 71966
  Description of Artificial Sequence: Synthetic oligonucleotide

SEQ ID NO: 419976 - DNA, 36 bp, Artificial Sequence; identical to SEQ ID NO: 71967
  Description of Artificial Sequence: Synthetic oligonucleotide

SEQ ID NO: 419977 - DNA, 35 bp, Artificial Sequence; identical to SEQ ID NO: 71968
  Description of Artificial Sequence: Synthetic oligonucleotide

SEQ ID NO: 419978 - DNA, 34 bp, Artificial Sequence; identical to SEQ ID NO: 71969
  Description of Artificial Sequence: Synthetic oligonucleotide

SEQ ID NO: 419979 - DNA, 34 bp, Artificial Sequence; identical to SEQ ID NO: 71970
  Description of Artificial Sequence: Synthetic oligonucleotide

SEQ ID NO: 419980 - DNA, 35 bp, Artificial Sequence; identical to SEQ ID NO: 71971
  Description of Artificial Sequence: Synthetic oligonucleotide

SEQ ID NO: 419981 - DNA, 34 bp, Artificial Sequence; identical to SEQ ID NO: 71972
  Description of Artificial Sequence: Synthetic oligonucleotide

SEQ ID NO: 419982 - DNA, 34 bp, Artificial Sequence; identical to SEQ ID NO: 71973
  Description of Artificial Sequence: Synthetic oligonucleotide

SEQ ID NO: 419983 - DNA, 34 bp, Artificial Sequence; identical to SEQ ID NO: 71974
  Description of Artificial Sequence: Synthetic oligonucleotide

SEQ ID NO: 419984 - DNA, 33 bp, Artificial Sequence; identical to SEQ ID NO: 71975
  Description of Artificial Sequence: Synthetic oligonucleotide

SEQ ID NO: 419985 - DNA, 33 bp, Artificial Sequence; identical to SEQ ID NO: 71976
  Description of Artificial Sequence: Synthetic oligonucleotide

SEQ ID NO: 419986 - DNA, 32 bp, Artificial Sequence; identical to SEQ ID NO: 71977
  Description of Artificial Sequence: Synthetic oligonucleotide

SEQ ID NO: 419987 - DNA, 34 bp, Artificial Sequence; identical to SEQ ID NO: 71978
  Description of Artificial Sequence: Synthetic oligonucleotide

SEQ ID NO: 419988 - DNA, 33 bp, Artificial Sequence; identical to SEQ ID NO: 71979
  Description of Artificial Sequence: Synthetic oligonucleotide

SEQ ID NO: 419989 - DNA, 32 bp, Artificial Sequence; identical to SEQ ID NO: 71980
  Description of Artificial Sequence: Synthetic oligonucleotide

SEQ ID NO: 419990 - DNA, 31 bp, Artificial Sequence; identical to SEQ ID NO: 71981
  Description of Artificial Sequence: Synthetic oligonucleotide

SEQ ID NO: 419991 - DNA, 31 bp, Artificial Sequence; identical to SEQ ID NO: 71982
  Description of Artificial Sequence: Synthetic oligonucleotide

SEQ ID NO: 419992 - DNA, 30 bp, Artificial Sequence; identical to SEQ ID NO: 71983
  Description of Artificial Sequence: Synthetic oligonucleotide

SEQ ID NO: 419993 - DNA, 29 bp, Artificial Sequence
  Description of Artificial Sequence: Synthetic oligonucleotide
ccataaccaggaagagttcgtgcgcttcg

SEQ ID NO: 419994 - DNA, 30 bp, Artificial Sequence; identical to SEQ ID NO: 71985
  Description of Artificial Sequence: Synthetic oligonucleotide

SEQ ID NO: 419995 - DNA, 31 bp, Artificial Sequence; identical to SEQ ID NO: 71986
  Description of Artificial Sequence: Synthetic oligonucleotide

SEQ ID NO: 419996 - DNA, 30 bp, Artificial Sequence; identical to SEQ ID NO: 71987
  Description of Artificial Sequence: Synthetic oligonucleotide

SEQ ID NO: 419997 - DNA, 29 bp, Artificial Sequence
  Description of Artificial Sequence: Synthetic oligonucleotide
aaccaggaagagttcgtgcgcttcgacag

SEQ ID NO: 419998 - DNA, 28 bp, Artificial Sequence
  Description of Artificial Sequence: Synthetic oligonucleotide
accaggaagagttcgtgcgcttcgacag

SEQ ID NO: 419999 - DNA, 27 bp, Artificial Sequence
  Description of Artificial Sequence: Synthetic oligonucleotide
ccaggaagagttcgtgcgcttcgacag

SEQ ID NO: 420000 - DNA, 27 bp, Artificial Sequence
  Description of Artificial Sequence: Synthetic oligonucleotide
caggaagagttcgtgcgcttcgacagc

SEQ ID NO: 420001 - DNA, 27 bp, Artificial Sequence
  Description of Artificial Sequence: Synthetic oligonucleotide
aggaagagttcgtgcgcttcgacagcg

SEQ ID NO: 420002 - DNA, 20 bp, Artificial Sequence
  Description of Artificial Sequence: Synthetic oligonucleotide
ctcctggagcggaggcgggg

SEQ ID NO: 420003 - DNA, 20 bp, Artificial Sequence
  Description of Artificial Sequence: Synthetic oligonucleotide
tcctggagcggaggcggggc

SEQ ID NO: 420004 - DNA, 20 bp, Artificial Sequence
  Description of Artificial Sequence: Synthetic oligonucleotide
cctggagcggaggcggggct

SEQ ID NO: 420005 - DNA, 20 bp, Artificial Sequence
  Description of Artificial Sequence: Synthetic oligonucleotide
ctggagcggaggcggggcct

SEQ ID NO: 420006 - DNA, 20 bp, Artificial Sequence
  Description of Artificial Sequence: Synthetic oligonucleotide
tggagcggaggcggggccgt

SEQ ID NO: 420007 - DNA, 20 bp, Artificial Sequence
  Description of Artificial Sequence: Synthetic oligonucleotide
ggagcggaggcggggccgtt

SEQ ID NO: 420008 - DNA, 20 bp, Artificial Sequence
  Description of Artificial Sequence: Synthetic oligonucleotide
gagcggaggcggggccggtt

SEQ ID NO: 420009 - DNA, 20 bp, Artificial Sequence
  Description of Artificial Sequence: Synthetic oligonucleotide
agcggaggcggggccgggtt

SEQ ID NO: 420010 - DNA, 20 bp, Artificial Sequence
  Description of Artificial Sequence: Synthetic oligonucleotide
gcggaggcggggccgggttt

SEQ ID NO: 420011 - DNA, 20 bp, Artificial Sequence
  Description of Artificial Sequence: Synthetic oligonucleotide
cggaggcggggccgggtgtt

SEQ ID NO: 420012 - DNA, 20 bp, Artificial Sequence
  Description of Artificial Sequence: Synthetic oligonucleotide
ggaggcggggccgggtggat

SEQ ID NO: 420013 - DNA, 20 bp, Artificial Sequence
  Description of Artificial Sequence: Synthetic oligonucleotide
gaggcggggccgggtggaca

SEQ ID NO: 420014 - DNA, 20 bp, Artificial Sequence
  Description of Artificial Sequence: Synthetic oligonucleotide
aggcggggccgggtggacac

SEQ ID NO: 420015 - DNA, 20 bp, Artificial Sequence
  Description of Artificial Sequence: Synthetic oligonucleotide
ggcggggccgggtggacact

SEQ ID NO: 420016 - DNA, 23 bp, Artificial Sequence
  Description of Artificial Sequence: Synthetic oligonucleotide
gcggggccgggtggacacctatt

SEQ ID NO: 420017 - DNA, 23 bp, Artificial Sequence
  Description of Artificial Sequence: Synthetic oligonucleotide
cggggccgggtggacacctattg

SEQ ID NO: 420018 - DNA, 24 bp, Artificial Sequence
  Description of Artificial Sequence: Synthetic oligonucleotide
ggggccgggtggacacctattgca

SEQ ID NO: 420019 - DNA, 25 bp, Artificial Sequence
  Description of Artificial Sequence: Synthetic oligonucleotide
gggccgggtggacacctattgcaga

SEQ ID NO: 420020 - DNA, 26 bp, Artificial Sequence
  Description of Artificial Sequence: Synthetic oligonucleotide
ggccgggtggacacctattgcagaca

SEQ ID NO: 420021 - DNA, 27 bp, Artificial Sequence
  Description of Artificial Sequence: Synthetic oligonucleotide
gccgggtggacacctattgcagacaca

SEQ ID NO: 420022 - DNA, 28 bp, Artificial Sequence
  Description of Artificial Sequence: Synthetic oligonucleotide
ccgggtggacacctattgcagacacaac

SEQ ID NO: 420023 - DNA, 30 bp, Artificial Sequence
  Description of Artificial Sequence: Synthetic oligonucleotide
cgggtggacacctattgcagacacaactac

SEQ ID NO: 420024 - DNA, 30 bp, Artificial Sequence
  Description of Artificial Sequence: Synthetic oligonucleotide
gggtggacacctattgcagacacaactacg

SEQ ID NO: 420025 - DNA, 25 bp, Artificial Sequence
  Description of Artificial Sequence: Synthetic oligonucleotide
aagcggggccgggtggacacctatt

SEQ ID NO: 420026 - DNA, 24 bp, Artificial Sequence
  Description of Artificial Sequence: Synthetic oligonucleotide
agcggggccgggtggacacctatt

SEQ ID NO: 420027 - DNA, 32 bp, Artificial Sequence
  Description of Artificial Sequence: Synthetic oligonucleotide
gtctgagtgtcatttcttcaatgggacggagg

SEQ ID NO: 420028 - DNA, 32 bp, Artificial Sequence
  Description of Artificial Sequence: Synthetic oligonucleotide
tctgagtgtcatttcttcaatgggacggaggg

SEQ ID NO: 420029 - DNA, 31 bp, Artificial Sequence
  Description of Artificial Sequence: Synthetic oligonucleotide
ctgagtgtcatttcttcaatgggacggaggg

SEQ ID NO: 420030 - DNA, 31 bp, Artificial Sequence
  Description of Artificial Sequence: Synthetic oligonucleotide
tgagtgtcatttcttcaatgggacggagggg

SEQ ID NO: 420031 - DNA, 30 bp, Artificial Sequence
  Description of Artificial Sequence: Synthetic oligonucleotide
gagtgtcatttcttcaatgggacggagggg

SEQ ID NO: 420032 - DNA, 30 bp, Artificial Sequence
  Description of Artificial Sequence: Synthetic oligonucleotide
agtgtcatttcttcaatgggacggaggggg

SEQ ID NO: 420033 - DNA, 29 bp, Artificial Sequence
  Description of Artificial Sequence: Synthetic oligonucleotide
gtgtcatttcttcaatgggacggaggggg

SEQ ID NO: 420034 - DNA, 24 bp, Artificial Sequence
  Description of Artificial Sequence: Synthetic oligonucleotide
aatgggacggagggggtgcggttc

SEQ ID NO: 420035 - DNA, 23 bp, Artificial Sequence
  Description of Artificial Sequence: Synthetic oligonucleotide
atgggacggagggggtgcggttc

SEQ ID NO: 420036 - DNA, 22 bp, Artificial Sequence
  Description of Artificial Sequence: Synthetic oligonucleotide
tgggacggagggggtgcggttc

SEQ ID NO: 420037 - DNA, 21 bp, Artificial Sequence
  Description of Artificial Sequence: Synthetic oligonucleotide
gggacggagggggtgcggttc

SEQ ID NO: 420038 - DNA, 22 bp, Artificial Sequence
  Description of Artificial Sequence: Synthetic oligonucleotide
ggacggagggggtgcggttcct

SEQ ID NO: 420039 - DNA, 22 bp, Artificial Sequence
  Description of Artificial Sequence: Synthetic oligonucleotide
gacggagggggtgcggttcctg

SEQ ID NO: 420040 - DNA, 23 bp, Artificial Sequence
  Description of Artificial Sequence: Synthetic oligonucleotide
acggagggggtgcggttcctgga

SEQ ID NO: 420041 - DNA, 22 bp, Artificial Sequence
  Description of Artificial Sequence: Synthetic oligonucleotide
cggagggggtgcggttcctgga

SEQ ID NO: 420042 - DNA, 23 bp, Artificial Sequence
  Description of Artificial Sequence: Synthetic oligonucleotide
ggagggggtgcggttcctggaca

SEQ ID NO: 420043 - DNA, 26 bp, Artificial Sequence
  Description of Artificial Sequence: Synthetic oligonucleotide
gagggggtgcggttcctggacagata

SEQ ID NO: 420044 - DNA, 27 bp, Artificial Sequence
  Description of Artificial Sequence: Synthetic oligonucleotide
agggggtgcggttcctggacagatact

SEQ ID NO: 420045 - DNA, 27 bp, Artificial Sequence
  Description of Artificial Sequence: Synthetic oligonucleotide
gggggtgcggttcctggacagatactt

SEQ ID NO: 420046 - DNA, 27 bp, Artificial Sequence
  Description of Artificial Sequence: Synthetic oligonucleotide
ggggtgcggttcctggacagatacttc

SEQ ID NO: 420047 - DNA, 38 bp, Artificial Sequence
  Description of Artificial Sequence: Synthetic oligonucleotide
caagtttcttggagtactctacgtctgagtgtcatttc

SEQ ID NO: 420048 - DNA, 40 bp, Artificial Sequence
  Description of Artificial Sequence: Synthetic oligonucleotide
aagtttcttggagtactctacgtctgagtgtcatttcttc

SEQ ID NO: 420049 - DNA, 39 bp, Artificial Sequence
  Description of Artificial Sequence: Synthetic oligonucleotide
agtttcttggagtactctacgtctgagtgtcatttcttc

SEQ ID NO: 420050 - DNA, 29 bp, Artificial Sequence
  Description of Artificial Sequence: Synthetic oligonucleotide
aactacggggttgtggagagcttcacagc

SEQ ID NO: 420051 - DNA, 28 bp, Artificial Sequence
  Description of Artificial Sequence: Synthetic oligonucleotide
actacggggttgtggagagcttcacagc

SEQ ID NO: 420052 - DNA, 27 bp, Artificial Sequence
  Description of Artificial Sequence: Synthetic oligonucleotide
ctacggggttgtggagagcttcacagc

SEQ ID NO: 420053 - DNA, 27 bp, Artificial Sequence
  Description of Artificial Sequence: Synthetic oligonucleotide
tacggggttgtggagagcttcacagcg

SEQ ID NO: 420054 - DNA, 26 bp, Artificial Sequence
  Description of Artificial Sequence: Synthetic oligonucleotide
acggggttgtggagagcttcacagcg

SEQ ID NO: 420055 - DNA, 25 bp, Artificial Sequence
  Description of Artificial Sequence: Synthetic oligonucleotide
cggggttgtggagagcttcacagcg

SEQ ID NO: 420056 - DNA, 26 bp, Artificial Sequence
  Description of Artificial Sequence: Synthetic oligonucleotide
ggggttgtggagagcttcacagcgca

SEQ ID NO: 420057 - DNA, 26 bp, Artificial Sequence
  Description of Artificial Sequence: Synthetic oligonucleotide
gggttgtggagagcttcacagcgcag

SEQ ID NO: 420058 - DNA, 26 bp, Artificial Sequence
  Description of Artificial Sequence: Synthetic oligonucleotide
ggttgtggagagcttcacagcgcagc

SEQ ID NO: 420059 - DNA, 26 bp, Artificial Sequence
  Description of Artificial Sequence: Synthetic oligonucleotide
gttgtggagagcttcacagcgcagcg

SEQ ID NO: 420060 - DNA, 26 bp, Artificial Sequence
  Description of Artificial Sequence: Synthetic oligonucleotide
ttgtggagagcttcacagcgcagcgg

SEQ ID NO: 420061 - DNA, 25 bp, Artificial Sequence
  Description of Artificial Sequence: Synthetic oligonucleotide
tgtggagagcttcacagcgcagcgg

SEQ ID NO: 420062 - DNA, 24 bp, Artificial Sequence
  Description of Artificial Sequence: Synthetic oligonucleotide
gtggagagcttcacagcgcagcgg

SEQ ID NO: 420063 - DNA, 24 bp, Artificial Sequence
  Description of Artificial Sequence: Synthetic oligonucleotide
tggagagcttcacagcgcagcggc

SEQ ID NO: 420064 - DNA, 23 bp, Artificial Sequence
  Description of Artificial Sequence: Synthetic oligonucleotide
ggagagcttcacagcgcagcggc

SEQ ID NO: 420065 - DNA, 24 bp, Artificial Sequence
  Description of Artificial Sequence: Synthetic oligonucleotide
gagagcttcacagcgcagcggcga

SEQ ID NO: 420066 - DNA, 24 bp, Artificial Sequence
  Description of Artificial Sequence: Synthetic oligonucleotide
agagcttcacagcgcagcggcgag

SEQ ID NO: 420067 - DNA, 38 bp, Artificial Sequence
  Description of Artificial Sequence: Synthetic oligonucleotide
ttggagtactctacgtctgagtgtcatttcttcaatgc

SEQ ID NO: 420068 - DNA, 37 bp, Artificial Sequence
  Description of Artificial Sequence: Synthetic oligonucleotide
tggagtactctacgtctgagtgtcatttcttcaatgc

SEQ ID NO: 420069 - DNA, 36 bp, Artificial Sequence
  Description of Artificial Sequence: Synthetic oligonucleotide
ggagtactctacgtctgagtgtcatttcttcaatgc

SEQ ID NO: 420070 - DNA, 36 bp, Artificial Sequence
  Description of Artificial Sequence: Synthetic oligonucleotide
gagtactctacgtctgagtgtcatttcttcaatgcg

SEQ ID NO: 420071 - DNA, 37 bp, Artificial Sequence
  Description of Artificial Sequence: Synthetic oligonucleotide
agtactctacgtctgagtgtcatttcttcaatgcgac

SEQ ID NO: 420072 - DNA, 36 bp, Artificial Sequence
  Description of Artificial Sequence: Synthetic oligonucleotide
gtactctacgtctgagtgtcatttcttcaatgcgac

SEQ ID NO: 420073 - DNA, 36 bp, Artificial Sequence
  Description of Artificial Sequence: Synthetic oligonucleotide
tactctacgtctgagtgtcatttcttcaatgcgacg

SEQ ID NO: 420074 - DNA, 35 bp, Artificial Sequence
  Description of Artificial Sequence: Synthetic oligonucleotide
actctacgtctgagtgtcatttcttcaatgcgacg

SEQ ID NO: 420075 - DNA, 34 bp, Artificial Sequence
  Description of Artificial Sequence: Synthetic oligonucleotide
ctctacgtctgagtgtcatttcttcaatgcgacg

SEQ ID NO: 420076 - DNA, 34 bp, Artificial Sequence
  Description of Artificial Sequence: Synthetic oligonucleotide
tctacgtctgagtgtcatttcttcaatgcgacgg

SEQ ID NO: 420077 - DNA, 33 bp, Artificial Sequence
  Description of Artificial Sequence: Synthetic oligonucleotide
ctacgtctgagtgtcatttcttcaatgcgacgg

SEQ ID NO: 420078 - DNA, 34 bp, Artificial Sequence
  Description of Artificial Sequence: Synthetic oligonucleotide
tacgtctgagtgtcatttcttcaatgcgacggag

SEQ ID NO: 420079 - DNA, 33 bp, Artificial Sequence
  Description of Artificial Sequence: Synthetic oligonucleotide
acgtctgagtgtcatttcttcaatgcgacggag

SEQ ID NO: 420080 - DNA, 32 bp, Artificial Sequence
  Description of Artificial Sequence: Synthetic oligonucleotide
cgtctgagtgtcatttcttcaatgcgacggag

SEQ ID NO: 420081 - DNA, 32 bp, Artificial Sequence
  Description of Artificial Sequence: Synthetic oligonucleotide
gtctgagtgtcatttcttcaatgcgacggagc

SEQ ID NO: 420082 - DNA, 32 bp, Artificial Sequence
  Description of Artificial Sequence: Synthetic oligonucleotide
tctgagtgtcatttcttcaatgcgacggagcg

SEQ ID NO: 420083 - DNA, 31 bp, Artificial Sequence
  Description of Artificial Sequence: Synthetic oligonucleotide
ctgagtgtcatttcttcaatgcgacggagcg

SEQ ID NO: 420084 - DNA, 31 bp, Artificial Sequence
  Description of Artificial Sequence: Synthetic oligonucleotide
tgagtgtcatttcttcaatgcgacggagcgg

SEQ ID NO: 420085 - DNA, 30 bp, Artificial Sequence; identical to SEQ ID NO: 72961
  Description of Artificial Sequence: Synthetic oligonucleotide

SEQ ID NO: 420086 - DNA, 30 bp, Artificial Sequence; identical to SEQ ID NO: 72962
  Description of Artificial Sequence: Synthetic oligonucleotide

SEQ ID NO: 420087 - DNA, 29 bp, Artificial Sequence
  Description of Artificial Sequence: Synthetic oligonucleotide
gtgtcatttcttcaatgcgacggagcggg

SEQ ID NO: 420088 - DNA, 30 bp, Artificial Sequence; identical to SEQ ID NO: 72964
  Description of Artificial Sequence: Synthetic oligonucleotide

SEQ ID NO: 420089 - DNA, 29 bp, Artificial Sequence
  Description of Artificial Sequence: Synthetic oligonucleotide
gtcatttcttcaatgcgacggagcgggtg

SEQ ID NO: 420090 - DNA, 29 bp, Artificial Sequence
  Description of Artificial Sequence: Synthetic oligonucleotide
tcatttcttcaatgcgacggagcgggtgc

SEQ ID NO: 420091 - DNA, 28 bp, Artificial Sequence
  Description of Artificial Sequence: Synthetic oligonucleotide
catttcttcaatgcgacggagcgggtgc

SEQ ID NO: 420092 - DNA, 28 bp, Artificial Sequence
  Description of Artificial Sequence: Synthetic oligonucleotide
atttcttcaatgcgacggagcgggtgcg

SEQ ID NO: 420093 - DNA, 27 bp, Artificial Sequence
  Description of Artificial Sequence: Synthetic oligonucleotide
tttcttcaatgcgacggagcgggtgcg

SEQ ID NO: 420094 - DNA, 26 bp, Artificial Sequence
  Description of Artificial Sequence: Synthetic oligonucleotide
ttcttcaatgcgacggagcgggtgcg

SEQ ID NO: 420095 - DNA, 25 bp, Artificial Sequence
  Description of Artificial Sequence: Synthetic oligonucleotide
tcttcaatgcgacggagcgggtgcg

SEQ ID NO: 420096 - DNA, 24 bp, Artificial Sequence
  Description of Artificial Sequence: Synthetic oligonucleotide
cttcaatgcgacggagcgggtgcg

SEQ ID NO: 420097 - DNA, 26 bp, Artificial Sequence
  Description of Artificial Sequence: Synthetic oligonucleotide
ttcaatgcgacggagcgggtgcggtt

SEQ ID NO: 420098 - DNA, 25 bp, Artificial Sequence
  Description of Artificial Sequence: Synthetic oligonucleotide
tcaatgcgacggagcgggtgcggtt

SEQ ID NO: 420099 - DNA, 24 bp, Artificial Sequence
  Description of Artificial Sequence: Synthetic oligonucleotide
caatgcgacggagcgggtgcggtt

SEQ ID NO: 420100 - DNA, 24 bp, Artificial Sequence
  Description of Artificial Sequence: Synthetic oligonucleotide
aatgcgacggagcgggtgcggttc

SEQ ID NO: 420101 - DNA, 23 bp, Artificial Sequence
  Description of Artificial Sequence: Synthetic oligonucleotide
atgcgacggagcgggtgcggttc

SEQ ID NO: 420102 - DNA, 22 bp, Artificial Sequence
  Description of Artificial Sequence: Synthetic oligonucleotide
tgcgacggagcgggtgcggttc

SEQ ID NO: 420103 - DNA, 21 bp, Artificial Sequence
  Description of Artificial Sequence: Synthetic oligonucleotide
gcgacggagcgggtgcggttc

SEQ ID NO: 420104 - DNA, 22 bp, Artificial Sequence
  Description of Artificial Sequence: Synthetic oligonucleotide
cgacggagcgggtgcggttcct

SEQ ID NO: 420105 - DNA, 25 bp, Artificial Sequence
  Description of Artificial Sequence: Synthetic oligonucleotide
ttcgtgcgcttcgacagcgacgtgc

SEQ ID NO: 420106 - DNA, 24 bp, Artificial Sequence
  Description of Artificial Sequence: Synthetic oligonucleotide
tcgtgcgcttcgacagcgacgtgc

SEQ ID NO: 420107 - DNA, 25 bp, Artificial Sequence
  Description of Artificial Sequence: Synthetic oligonucleotide
gcttcgacagcgacgtgcgggagta

SEQ ID NO: 420108 - DNA, 25 bp, Artificial Sequence
  Description of Artificial Sequence: Synthetic oligonucleotide
cttcgacagcgacgtgcgggagtac

SEQ ID NO: 420109 - DNA, 25 bp, Artificial Sequence
  Description of Artificial Sequence: Synthetic oligonucleotide
ttcgacagcgacgtgcgggagtacc

SEQ ID NO: 420110 - DNA, 24 bp, Artificial Sequence
  Description of Artificial Sequence: Synthetic oligonucleotide
tcgacagcgacgtgcgggagtacc

SEQ ID NO: 420111 - DNA, 23 bp, Artificial Sequence
  Description of Artificial Sequence: Synthetic oligonucleotide
cgacagcgacgtgcgggagtacc

SEQ ID NO: 420112 - DNA, 23 bp, Artificial Sequence
  Description of Artificial Sequence: Synthetic oligonucleotide
gacagcgacgtgcgggagtaccg

SEQ ID NO: 420113 - DNA, 23 bp, Artificial Sequence
  Description of Artificial Sequence: Synthetic oligonucleotide
acagcgacgtgcgggagtaccgg

SEQ ID NO: 420114 - DNA, 22 bp, Artificial Sequence
  Description of Artificial Sequence: Synthetic oligonucleotide
cagcgacgtgcgggagtaccgg

SEQ ID NO: 420115 - DNA, 22 bp, Artificial Sequence
  Description of Artificial Sequence: Synthetic oligonucleotide
agcgacgtgcgggagtaccggg

SEQ ID NO: 420116 - DNA, 21 bp, Artificial Sequence
  Description of Artificial Sequence: Synthetic oligonucleotide
gcgacgtgcgggagtaccggg

SEQ ID NO: 420117 - DNA, 21 bp, Artificial Sequence
  Description of Artificial Sequence: Synthetic oligonucleotide
cgacgtgcgggagtaccgggc

SEQ ID NO: 420118 - DNA, 21 bp, Artificial Sequence
  Description of Artificial Sequence: Synthetic oligonucleotide
gacgtgcgggagtaccgggcg

SEQ ID NO: 420119 - DNA, 22 bp, Artificial Sequence
  Description of Artificial Sequence: Synthetic oligonucleotide
acgtgcgggagtaccgggcggt

SEQ ID NO: 420120 - DNA, 21 bp, Artificial Sequence
  Description of Artificial Sequence: Synthetic oligonucleotide
cgtgcgggagtaccgggcggt

SEQ ID NO: 420121 - DNA, 22 bp, Artificial Sequence
  Description of Artificial Sequence: Synthetic oligonucleotide
gtgcgggagtaccgggcggtga

SEQ ID NO: 420122 - DNA, 22 bp, Artificial Sequence
  Description of Artificial Sequence: Synthetic oligonucleotide
tgcgggagtaccgggcggtgac

SEQ ID NO: 420123 - DNA, 21 bp, Artificial Sequence
  Description of Artificial Sequence: Synthetic oligonucleotide
gcgggagtaccgggcggtgac

SEQ ID NO: 420124 - DNA, 21 bp, Artificial Sequence
  Description of Artificial Sequence: Synthetic oligonucleotide
cgggagtaccgggcggtgacg

SEQ ID NO: 420125 - DNA, 25 bp, Artificial Sequence
  Description of Artificial Sequence: Synthetic oligonucleotide
ggaggcgggccgaggtggacaatta

SEQ ID NO: 420126 - DNA, 31 bp, Artificial Sequence; identical to SEQ ID NO: 72040
  Description of Artificial Sequence: Synthetic oligonucleotide

SEQ ID NO: 420127 - DNA, 32 bp, Artificial Sequence; identical to SEQ ID NO: 72041
  Description of Artificial Sequence: Synthetic oligonucleotide

SEQ ID NO: 420128 - DNA, 31 bp, Artificial Sequence; identical to SEQ ID NO: 72042
  Description of Artificial Sequence: Synthetic oligonucleotide

SEQ ID NO: 420129 - DNA, 35 bp, Artificial Sequence; identical to SEQ ID NO: 72043
  Description of Artificial Sequence: Synthetic oligonucleotide

SEQ ID NO: 420130 - DNA, 37 bp, Artificial Sequence; identical to SEQ ID NO: 72044
  Description of Artificial Sequence: Synthetic oligonucleotide

SEQ ID NO: 420131 - DNA, 36 bp, Artificial Sequence; identical to SEQ ID NO: 72045
  Description of Artificial Sequence: Synthetic oligonucleotide

SEQ ID NO: 420132 - DNA, 35 bp, Artificial Sequence; identical to SEQ ID NO: 72046
  Description of Artificial Sequence: Synthetic oligonucleotide

SEQ ID NO: 420133 - DNA, 34 bp, Artificial Sequence; identical to SEQ ID NO: 72047
  Description of Artificial Sequence: Synthetic oligonucleotide

SEQ ID NO: 420134 - DNA, 37 bp, Artificial Sequence; identical to SEQ ID NO: 72048
  Description of Artificial Sequence: Synthetic oligonucleotide

SEQ ID NO: 420135 - DNA, 36 bp, Artificial Sequence; identical to SEQ ID NO: 72049
  Description of Artificial Sequence: Synthetic oligonucleotide

SEQ ID NO: 420136 - DNA, 35 bp, Artificial Sequence; identical to SEQ ID NO: 72050
  Description of Artificial Sequence: Synthetic oligonucleotide

SEQ ID NO: 420137 - DNA, 35 bp, Artificial Sequence; identical to SEQ ID NO: 72051
  Description of Artificial Sequence: Synthetic oligonucleotide

SEQ ID NO: 420138 - DNA, 35 bp, Artificial Sequence; identical to SEQ ID NO: 72052
  Description of Artificial Sequence: Synthetic oligonucleotide

SEQ ID NO: 420139 - DNA, 34 bp, Artificial Sequence; identical to SEQ ID NO: 72053
  Description of Artificial Sequence: Synthetic oligonucleotide

SEQ ID NO: 420140 - DNA, 35 bp, Artificial Sequence; identical to SEQ ID NO: 72054
  Description of Artificial Sequence: Synthetic oligonucleotide

SEQ ID NO: 420141 - DNA, 34 bp, Artificial Sequence; identical to SEQ ID NO: 72055
  Description of Artificial Sequence: Synthetic oligonucleotide

SEQ ID NO: 420142 - DNA, 33 bp, Artificial Sequence; identical to SEQ ID NO: 72056
  Description of Artificial Sequence: Synthetic oligonucleotide

SEQ ID NO: 420143 - DNA, 33 bp, Artificial Sequence; identical to SEQ ID NO: 72057
  Description of Artificial Sequence: Synthetic oligonucleotide

SEQ ID NO: 420144 - DNA, 33 bp, Artificial Sequence; identical to SEQ ID NO: 72058
  Description of Artificial Sequence: Synthetic oligonucleotide

SEQ ID NO: 420145 - DNA, 32 bp, Artificial Sequence; identical to SEQ ID NO: 72059
  Description of Artificial Sequence: Synthetic oligonucleotide

SEQ ID NO: 420146 - DNA, 33 bp, Artificial Sequence; identical to SEQ ID NO: 72060
  Description of Artificial Sequence: Synthetic oligonucleotide

SEQ ID NO: 420147 - DNA, 33 bp, Artificial Sequence; identical to SEQ ID NO: 72061
  Description of Artificial Sequence: Synthetic oligonucleotide

SEQ ID NO: 420148 - DNA, 32 bp, Artificial Sequence; identical to SEQ ID NO: 72062
  Description of Artificial Sequence: Synthetic oligonucleotide

SEQ ID NO: 420149 - DNA, 20 bp, Artificial Sequence
  Description of Artificial Sequence: Synthetic oligonucleotide
ggaggcgggccgaggtggac

SEQ ID NO: 420150 - DNA, 20 bp, Artificial Sequence
  Description of Artificial Sequence: Synthetic oligonucleotide
gaggcgggccgaggtggacg

SEQ ID NO: 420151 - DNA, 20 bp, Artificial Sequence
  Description of Artificial Sequence: Synthetic oligonucleotide
aggcgggccgaggtggacgc

SEQ ID NO: 420152 - DNA, 20 bp, Artificial Sequence
  Description of Artificial Sequence: Synthetic oligonucleotide
ggcgggccgaggtggacgct

SEQ ID NO: 420153 - DNA, 23 bp, Artificial Sequence
  Description of Artificial Sequence: Synthetic oligonucleotide
gcgggccgaggtggacgcctatt

SEQ ID NO: 420154 - DNA, 23 bp, Artificial Sequence
  Description of Artificial Sequence: Synthetic oligonucleotide
cgggccgaggtggacgcctattg

SEQ ID NO: 420155 - DNA, 24 bp, Artificial Sequence
  Description of Artificial Sequence: Synthetic oligonucleotide
gggccgaggtggacgcctattgca

SEQ ID NO: 420156 - DNA, 25 bp, Artificial Sequence
  Description of Artificial Sequence: Synthetic oligonucleotide
ggccgaggtggacgcctattgcaga

SEQ ID NO: 420157 - DNA, 26 bp, Artificial Sequence
  Description of Artificial Sequence: Synthetic oligonucleotide
gccgaggtggacgcctattgcagaca

SEQ ID NO: 420158 - DNA, 27 bp, Artificial Sequence
  Description of Artificial Sequence: Synthetic oligonucleotide
ccgaggtggacgcctattgcagacaca

SEQ ID NO: 420159 - DNA, 28 bp, Artificial Sequence
  Description of Artificial Sequence: Synthetic oligonucleotide
cgaggtggacgcctattgcagacacaac

SEQ ID NO: 420160 - DNA, 30 bp, Artificial Sequence; identical to SEQ ID NO: 72074
  Description of Artificial Sequence: Synthetic oligonucleotide

SEQ ID NO: 420161 - DNA, 30 bp, Artificial Sequence; identical to SEQ ID NO: 72075
  Description of Artificial Sequence: Synthetic oligonucleotide

SEQ ID NO: 420162 - DNA, 29 bp, Artificial Sequence
  Description of Artificial Sequence: Synthetic oligonucleotide
ggtggacgcctattgcagacacaactacg

SEQ ID NO: 420163 - DNA, 29 bp, Artificial Sequence
  Description of Artificial Sequence: Synthetic oligonucleotide
gtggacgcctattgcagacacaactacgg

SEQ ID NO: 420164 - DNA, 29 bp, Artificial Sequence
  Description of Artificial Sequence: Synthetic oligonucleotide
tggacgcctattgcagacacaactacggg

SEQ ID NO: 420165 - DNA, 28 bp, Artificial Sequence
  Description of Artificial Sequence: Synthetic oligonucleotide
ggacgcctattgcagacacaactacggg

SEQ ID NO: 420166 - DNA, 28 bp, Artificial Sequence
  Description of Artificial Sequence: Synthetic oligonucleotide
gacgcctattgcagacacaactacgggg

SEQ ID NO: 420167 - DNA, 30 bp, Artificial Sequence; identical to SEQ ID NO: 72081
  Description of Artificial Sequence: Synthetic oligonucleotide

SEQ ID NO: 420168 - DNA, 29 bp, Artificial Sequence
  Description of Artificial Sequence: Synthetic oligonucleotide
cgcctattgcagacacaactacggggttg

SEQ ID NO: 420169 - DNA, 30 bp, Artificial Sequence; identical to SEQ ID NO: 72083
  Description of Artificial Sequence: Synthetic oligonucleotide

SEQ ID NO: 420170 - DNA, 27 bp, Artificial Sequence
  Description of Artificial Sequence: Synthetic oligonucleotide
gaacagccagaaggacatcctggagcg

SEQ ID NO: 420171 - DNA, 27 bp, Artificial Sequence
  Description of Artificial Sequence: Synthetic oligonucleotide
aacagccagaaggacatcctggagcgg

SEQ ID NO: 420172 - DNA, 27 bp, Artificial Sequence
  Description of Artificial Sequence: Synthetic oligonucleotide
acagccagaaggacatcctggagcgga

SEQ ID NO: 420173 - DNA, 26 bp, Artificial Sequence
  Description of Artificial Sequence: Synthetic oligonucleotide
cagccagaaggacatcctggagcgga

SEQ ID NO: 420174 - DNA, 26 bp, Artificial Sequence
  Description of Artificial Sequence: Synthetic oligonucleotide
agccagaaggacatcctggagcggag

SEQ ID NO: 420175 - DNA, 25 bp, Artificial Sequence
  Description of Artificial Sequence: Synthetic oligonucleotide
gccagaaggacatcctggagcggag

SEQ ID NO: 420176 - DNA, 25 bp, Artificial Sequence
  Description of Artificial Sequence: Synthetic oligonucleotide
ccagaaggacatcctggagcggagg

SEQ ID NO: 420177 - DNA, 25 bp, Artificial Sequence
  Description of Artificial Sequence: Synthetic oligonucleotide
cagaaggacatcctggagcggaggc

SEQ ID NO: 420178 - DNA, 25 bp, Artificial Sequence
  Description of Artificial Sequence: Synthetic oligonucleotide
agaaggacatcctggagcggaggcg

SEQ ID NO: 420179 - DNA, 24 bp, Artificial Sequence
  Description of Artificial Sequence: Synthetic oligonucleotide
gaaggacatcctggagcggaggcg

SEQ ID NO: 420180 - DNA, 24 bp, Artificial Sequence
  Description of Artificial Sequence: Synthetic oligonucleotide
aaggacatcctggagcggaggcgg

SEQ ID NO: 420181 - DNA, 23 bp, Artificial Sequence
  Description of Artificial Sequence: Synthetic oligonucleotide
aggacatcctggagcggaggcgg

SEQ ID NO: 420182 - DNA, 22 bp, Artificial Sequence
  Description of Artificial Sequence: Synthetic oligonucleotide
ggacatcctggagcggaggcgg

SEQ ID NO: 420183 - DNA, 22 bp, Artificial Sequence
  Description of Artificial Sequence: Synthetic oligonucleotide
gacatcctggagcggaggcggg

SEQ ID NO: 420184 - DNA, 22 bp, Artificial Sequence
  Description of Artificial Sequence: Synthetic oligonucleotide
acatcctggagcggaggcgggc

SEQ ID NO: 420185 - DNA, 21 bp, Artificial Sequence
  Description of Artificial Sequence: Synthetic oligonucleotide
catcctggagcggaggcgggc

SEQ ID NO: 420186 - DNA, 21 bp, Artificial Sequence
  Description of Artificial Sequence: Synthetic oligonucleotide
atcctggagcggaggcgggcc

SEQ ID NO: 420187 - DNA, 27 bp, Artificial Sequence
  Description of Artificial Sequence: Synthetic oligonucleotide
gggacaccagaccacgtttcttggagc

SEQ ID NO: 420188 - DNA, 28 bp, Artificial Sequence
  Description of Artificial Sequence: Synthetic oligonucleotide
ggacaccagaccacgtttcttggagctg

SEQ ID NO: 420189 - DNA, 28 bp, Artificial Sequence
  Description of Artificial Sequence: Synthetic oligonucleotide
gacaccagaccacgtttcttggagctgc

SEQ ID NO: 420190 - DNA, 28 bp, Artificial Sequence
  Description of Artificial Sequence: Synthetic oligonucleotide
acaccagaccacgtttcttggagctgcg

SEQ ID NO: 420191 - DNA, 27 bp, Artificial Sequence
  Description of Artificial Sequence: Synthetic oligonucleotide
caccagaccacgtttcttggagctgcg

SEQ ID NO: 420192 - DNA, 30 bp, Artificial Sequence; identical to SEQ ID NO: 72106
  Description of Artificial Sequence: Synthetic oligonucleotide

SEQ ID NO: 420193 - DNA, 29 bp, Artificial Sequence
  Description of Artificial Sequence: Synthetic oligonucleotide
ccagaccacgtttcttggagctgcgtaag

SEQ ID NO: 420194 - DNA, 30 bp, Artificial Sequence; identical to SEQ ID NO: 72108
  Description of Artificial Sequence: Synthetic oligonucleotide

SEQ ID NO: 420195 - DNA, 31 bp, Artificial Sequence; identical to SEQ ID NO: 72109
  Description of Artificial Sequence: Synthetic oligonucleotide

SEQ ID NO: 420196 - DNA, 30 bp, Artificial Sequence; identical to SEQ ID NO: 72110
  Description of Artificial Sequence: Synthetic oligonucleotide

SEQ ID NO: 420197 - DNA, 31 bp, Artificial Sequence; identical to SEQ ID NO: 72111
  Description of Artificial Sequence: Synthetic oligonucleotide

SEQ ID NO: 420198 - DNA, 30 bp, Artificial Sequence; identical to SEQ ID NO: 72112
  Description of Artificial Sequence: Synthetic oligonucleotide

SEQ ID NO: 420199 - DNA, 20 bp, Artificial Sequence
  Description of Artificial Sequence: Synthetic oligonucleotide
ctggagcggaggcgggccct

SEQ ID NO: 420200 - DNA, 20 bp, Artificial Sequence
  Description of Artificial Sequence: Synthetic oligonucleotide
tggagcggaggcgggccctg

SEQ ID NO: 420201 - DNA, 20 bp, Artificial Sequence
  Description of Artificial Sequence: Synthetic oligonucleotide
ggagcggaggcgggccctgt

SEQ ID NO: 420202 - DNA, 20 bp, Artificial Sequence
  Description of Artificial Sequence: Synthetic oligonucleotide
gagcggaggcgggccctggt

SEQ ID NO: 420203 - DNA, 20 bp, Artificial Sequence
  Description of Artificial Sequence: Synthetic oligonucleotide
agcggaggcgggccctggtg

SEQ ID NO: 420204 - DNA, 20 bp, Artificial Sequence
  Description of Artificial Sequence: Synthetic oligonucleotide
gcggaggcgggccctggtgt

SEQ ID NO: 420205 - DNA, 20 bp, Artificial Sequence
  Description of Artificial Sequence: Synthetic oligonucleotide
cggaggcgggccctggtgga

SEQ ID NO: 420206 - DNA, 21 bp, Artificial Sequence
  Description of Artificial Sequence: Synthetic oligonucleotide
ggaggcgggccctggtggaca

SEQ ID NO: 420207 - DNA, 22 bp, Artificial Sequence
  Description of Artificial Sequence: Synthetic oligonucleotide
gacctcctggagcggaggcggt

SEQ ID NO: 420208 - DNA, 22 bp, Artificial Sequence
  Description of Artificial Sequence: Synthetic oligonucleotide
acctcctggagcggaggcggtc

SEQ ID NO: 420209 - DNA, 21 bp, Artificial Sequence
  Description of Artificial Sequence: Synthetic oligonucleotide
cctcctggagcggaggcggtc

SEQ ID NO: 420210 - DNA, 21 bp, Artificial Sequence
  Description of Artificial Sequence: Synthetic oligonucleotide
ctcctggagcggaggcggtcc

SEQ ID NO: 420211 - DNA, 22 bp, Artificial Sequence
  Description of Artificial Sequence: Synthetic oligonucleotide
tcctggagcggaggcggtccga

SEQ ID NO: 420212 - DNA, 21 bp, Artificial Sequence
  Description of Artificial Sequence: Synthetic oligonucleotide
cctggagcggaggcggtccga

SEQ ID NO: 420213 - DNA, 21 bp, Artificial Sequence
  Description of Artificial Sequence: Synthetic oligonucleotide
ctggagcggaggcggtccgag

SEQ ID NO: 420214 - DNA, 22 bp, Artificial Sequence
  Description of Artificial Sequence: Synthetic oligonucleotide
tggagcggaggcggtccgaggt

SEQ ID NO: 420215 - DNA, 21 bp, Artificial Sequence
  Description of Artificial Sequence: Synthetic oligonucleotide
ggagcggaggcggtccgaggt

SEQ ID NO: 420216 - DNA, 21 bp, Artificial Sequence
  Description of Artificial Sequence: Synthetic oligonucleotide
gagcggaggcggtccgaggtg

SEQ ID NO: 420217 - DNA, 22 bp, Artificial Sequence
  Description of Artificial Sequence: Synthetic oligonucleotide
agcggaggcggtccgaggtgga

SEQ ID NO: 420218 - DNA, 21 bp, Artificial Sequence
  Description of Artificial Sequence: Synthetic oligonucleotide
gcggaggcggtccgaggtgga

SEQ ID NO: 420219 - DNA, 22 bp, Artificial Sequence
  Description of Artificial Sequence: Synthetic oligonucleotide
cggaggcggtccgaggtggaca

SEQ ID NO: 420220 - DNA, 22 bp, Artificial Sequence
  Description of Artificial Sequence: Synthetic oligonucleotide
ggaggcggtccgaggtggacac

SEQ ID NO: 420221 - DNA, 26 bp, Artificial Sequence
  Description of Artificial Sequence: Synthetic oligonucleotide
gaggcggtccgaggtggacacctatt

SEQ ID NO: 420222 - DNA, 26 bp, Artificial Sequence
  Description of Artificial Sequence: Synthetic oligonucleotide
aggcggtccgaggtggacacctattg

SEQ ID NO: 420223 - DNA, 25 bp, Artificial Sequence
  Description of Artificial Sequence: Synthetic oligonucleotide
ggcggtccgaggtggacacctattg

SEQ ID NO: 420224 - DNA, 26 bp, Artificial Sequence
  Description of Artificial Sequence: Synthetic oligonucleotide
gcggtccgaggtggacacctattgca

SEQ ID NO: 420225 - DNA, 27 bp, Artificial Sequence
  Description of Artificial Sequence: Synthetic oligonucleotide
cggtccgaggtggacacctattgcaga

SEQ ID NO: 420226 - DNA, 27 bp, Artificial Sequence
  Description of Artificial Sequence: Synthetic oligonucleotide
ggtccgaggtggacacctattgcagac

SEQ ID NO: 420227 - DNA, 28 bp, Artificial Sequence
  Description of Artificial Sequence: Synthetic oligonucleotide
gtccgaggtggacacctattgcagacac

SEQ ID NO: 420228 - DNA, 30 bp, Artificial Sequence; identical to SEQ ID NO: 72153
  Description of Artificial Sequence: Synthetic oligonucleotide

SEQ ID NO: 420229 - DNA, 28 bp, Artificial Sequence
  Description of Artificial Sequence: Synthetic oligonucleotide
ggacaccagaccacgtttcttggagcag

SEQ ID NO: 420230 - DNA, 28 bp, Artificial Sequence
  Description of Artificial Sequence: Synthetic oligonucleotide
gacaccagaccacgtttcttggagcagg

SEQ ID NO: 420231 - DNA, 33 bp, Artificial Sequence; identical to SEQ ID NO: 72156
  Description of Artificial Sequence: Synthetic oligonucleotide

SEQ ID NO: 420232 - DNA, 32 bp, Artificial Sequence; identical to SEQ ID NO: 72157
  Description of Artificial Sequence: Synthetic oligonucleotide

SEQ ID NO: 420233 - DNA, 34 bp, Artificial Sequence; identical to SEQ ID NO: 72158
  Description of Artificial Sequence: Synthetic oligonucleotide

SEQ ID NO: 420234 - DNA, 33 bp, Artificial Sequence; identical to SEQ ID NO: 72159
  Description of Artificial Sequence: Synthetic oligonucleotide

SEQ ID NO: 420235 - DNA, 34 bp, Artificial Sequence; identical to SEQ ID NO: 72160
  Description of Artificial Sequence: Synthetic oligonucleotide

SEQ ID NO: 420236 - DNA, 35 bp, Artificial Sequence; identical to SEQ ID NO: 72161
  Description of Artificial Sequence: Synthetic oligonucleotide

SEQ ID NO: 420237 - DNA, 27 bp, Artificial Sequence
  Description of Artificial Sequence: Synthetic oligonucleotide
agttcgtgcgcttcgacagcgacgtga

SEQ ID NO: 420238 - DNA, 26 bp, Artificial Sequence
  Description of Artificial Sequence: Synthetic oligonucleotide
gttcgtgcgcttcgacagcgacgtga

SEQ ID NO: 420239 - DNA, 26 bp, Artificial Sequence
  Description of Artificial Sequence: Synthetic oligonucleotide
ttcgtgcgcttcgacagcgacgtgag

SEQ ID NO: 420240 - DNA, 25 bp, Artificial Sequence
  Description of Artificial Sequence: Synthetic oligonucleotide
tcgtgcgcttcgacagcgacgtgag

SEQ ID NO: 420241 - DNA, 23 bp, Artificial Sequence
  Description of Artificial Sequence: Synthetic oligonucleotide
tgacggagctggggcggcctact

SEQ ID NO: 420242 - DNA, 22 bp, Artificial Sequence
  Description of Artificial Sequence: Synthetic oligonucleotide
gacggagctggggcggcctact

SEQ ID NO: 420243 - DNA, 22 bp, Artificial Sequence
  Description of Artificial Sequence: Synthetic oligonucleotide
acggagctggggcggcctactg

SEQ ID NO: 420244 - DNA, 21 bp, Artificial Sequence
  Description of Artificial Sequence: Synthetic oligonucleotide
cggagctggggcggcctactg

SEQ ID NO: 420245 - DNA, 21 bp, Artificial Sequence
  Description of Artificial Sequence: Synthetic oligonucleotide
ggagctggggcggcctactgc

SEQ ID NO: 420246 - DNA, 21 bp, Artificial Sequence
  Description of Artificial Sequence: Synthetic oligonucleotide
gagctggggcggcctactgcg

SEQ ID NO: 420247 - DNA, 22 bp, Artificial Sequence
  Description of Artificial Sequence: Synthetic oligonucleotide
agctggggcggcctactgcgga

SEQ ID NO: 420248 - DNA, 21 bp, Artificial Sequence
  Description of Artificial Sequence: Synthetic oligonucleotide
gctggggcggcctactgcgga

SEQ ID NO: 420249 - DNA, 21 bp, Artificial Sequence
  Description of Artificial Sequence: Synthetic oligonucleotide
ctggggcggcctactgcggag

SEQ ID NO: 420250 - DNA, 22 bp, Artificial Sequence
  Description of Artificial Sequence: Synthetic oligonucleotide
tggggcggcctactgcggagca

SEQ ID NO: 420251 - DNA, 21 bp, Artificial Sequence
  Description of Artificial Sequence: Synthetic oligonucleotide
ggggcggcctactgcggagca

SEQ ID NO: 420252 - DNA, 22 bp, Artificial Sequence
  Description of Artificial Sequence: Synthetic oligonucleotide
gggcggcctactgcggagcact

SEQ ID NO: 420253 - DNA, 22 bp, Artificial Sequence
  Description of Artificial Sequence: Synthetic oligonucleotide
ggcggcctactgcggagcactg

SEQ ID NO: 420254 - DNA, 24 bp, Artificial Sequence
  Description of Artificial Sequence: Synthetic oligonucleotide
gcggcctactgcggagcactggaa

SEQ ID NO: 420255 - DNA, 25 bp, Artificial Sequence
  Description of Artificial Sequence: Synthetic oligonucleotide
cggcctactgcggagcactggaaca

SEQ ID NO: 420256 - DNA, 25 bp, Artificial Sequence
  Description of Artificial Sequence: Synthetic oligonucleotide
ggcctactgcggagcactggaacag

SEQ ID NO: 420257 - DNA, 25 bp, Artificial Sequence
  Description of Artificial Sequence: Synthetic oligonucleotide
gcctactgcggagcactggaacagc

SEQ ID NO: 420258 - DNA, 26 bp, Artificial Sequence
  Description of Artificial Sequence: Synthetic oligonucleotide
cctactgcggagcactggaacagcca

SEQ ID NO: 420259 - DNA, 27 bp, Artificial Sequence
  Description of Artificial Sequence: Synthetic oligonucleotide
ctactgcggagcactggaacagccaga

SEQ ID NO: 420260 - DNA, 28 bp, Artificial Sequence
  Description of Artificial Sequence: Synthetic oligonucleotide
tactgcggagcactggaacagccagaag

SEQ ID NO: 420261 - DNA, 27 bp, Artificial Sequence
  Description of Artificial Sequence: Synthetic oligonucleotide
actgcggagcactggaacagccagaag

SEQ ID NO: 420262 - DNA, 24 bp, Artificial Sequence
  Description of Artificial Sequence: Synthetic oligonucleotide
gagcgggtgcggttcctggacaga

SEQ ID NO: 420263 - DNA, 25 bp, Artificial Sequence
  Description of Artificial Sequence: Synthetic oligonucleotide
agcgggtgcggttcctggacagaca

SEQ ID NO: 420264 - DNA, 24 bp, Artificial Sequence
  Description of Artificial Sequence: Synthetic oligonucleotide
gcgggtgcggttcctggacagaca

SEQ ID NO: 420265 - DNA, 26 bp, Artificial Sequence
  Description of Artificial Sequence: Synthetic oligonucleotide
cgggtgcggttcctggacagacactt

SEQ ID NO: 420266 - DNA, 26 bp, Artificial Sequence
  Description of Artificial Sequence: Synthetic oligonucleotide
gggtgcggttcctggacagacacttc

SEQ ID NO: 420267 - DNA, 27 bp, Artificial Sequence
  Description of Artificial Sequence: Synthetic oligonucleotide
ggtgcggttcctggacagacacttcca

SEQ ID NO: 420268 - DNA, 30 bp, Artificial Sequence; identical to SEQ ID NO: 72193
  Description of Artificial Sequence: Synthetic oligonucleotide

SEQ ID NO: 420269 - DNA, 30 bp, Artificial Sequence; identical to SEQ ID NO: 72194
  Description of Artificial Sequence: Synthetic oligonucleotide

SEQ ID NO: 420270 - DNA, 29 bp, Artificial Sequence
  Description of Artificial Sequence: Synthetic oligonucleotide
gcggttcctggacagacacttccataacc

SEQ ID NO: 420271 - DNA, 30 bp, Artificial Sequence; identical to SEQ ID NO: 72196
  Description of Artificial Sequence: Synthetic oligonucleotide

SEQ ID NO: 420272 - DNA, 30 bp, Artificial Sequence; identical to SEQ ID NO: 72197
  Description of Artificial Sequence: Synthetic oligonucleotide

SEQ ID NO: 420273 - DNA, 31 bp, Artificial Sequence; identical to SEQ ID NO: 72198
  Description of Artificial Sequence: Synthetic oligonucleotide

SEQ ID NO: 420274 - DNA, 31 bp, Artificial Sequence; identical to SEQ ID NO: 72199
  Description of Artificial Sequence: Synthetic oligonucleotide

SEQ ID NO: 420275 - DNA, 30 bp, Artificial Sequence; identical to SEQ ID NO: 72200
  Description of Artificial Sequence: Synthetic oligonucleotide

SEQ ID NO: 420276 - DNA, 29 bp, Artificial Sequence
  Description of Artificial Sequence: Synthetic oligonucleotide
cctggacagacacttccataaccaggagg

SEQ ID NO: 420277 - DNA, 30 bp, Artificial Sequence; identical to SEQ ID NO: 72202
  Description of Artificial Sequence: Synthetic oligonucleotide

SEQ ID NO: 420278 - DNA, 32 bp, Artificial Sequence; identical to SEQ ID NO: 72203
  Description of Artificial Sequence: Synthetic oligonucleotide

SEQ ID NO: 420279 - DNA, 31 bp, Artificial Sequence; identical to SEQ ID NO: 72204
  Description of Artificial Sequence: Synthetic oligonucleotide

SEQ ID NO: 420280 - DNA, 31 bp, Artificial Sequence; identical to SEQ ID NO: 72205
  Description of Artificial Sequence: Synthetic oligonucleotide

SEQ ID NO: 420281 - DNA, 32 bp, Artificial Sequence; identical to SEQ ID NO: 72206
  Description of Artificial Sequence: Synthetic oligonucleotide

SEQ ID NO: 420282 - DNA, 31 bp, Artificial Sequence; identical to SEQ ID NO: 72207
  Description of Artificial Sequence: Synthetic oligonucleotide

SEQ ID NO: 420283 - DNA, 33 bp, Artificial Sequence; identical to SEQ ID NO: 72208
  Description of Artificial Sequence: Synthetic oligonucleotide

SEQ ID NO: 420284 - DNA, 33 bp, Artificial Sequence; identical to SEQ ID NO: 72209
  Description of Artificial Sequence: Synthetic oligonucleotide

SEQ ID NO: 420285 - DNA, 32 bp, Artificial Sequence; identical to SEQ ID NO: 72210
  Description of Artificial Sequence: Synthetic oligonucleotide

SEQ ID NO: 420286 - DNA, 33 bp, Artificial Sequence; identical to SEQ ID NO: 72211
  Description of Artificial Sequence: Synthetic oligonucleotide

SEQ ID NO: 420287 - DNA, 32 bp, Artificial Sequence; identical to SEQ ID NO: 72212
  Description of Artificial Sequence: Synthetic oligonucleotide

SEQ ID NO: 420288 - DNA, 33 bp, Artificial Sequence; identical to SEQ ID NO: 72213
  Description of Artificial Sequence: Synthetic oligonucleotide

SEQ ID NO: 420289 - DNA, 33 bp, Artificial Sequence; identical to SEQ ID NO: 72214
  Description of Artificial Sequence: Synthetic oligonucleotide

SEQ ID NO: 420290 - DNA, 32 bp, Artificial Sequence; identical to SEQ ID NO: 72215
  Description of Artificial Sequence: Synthetic oligonucleotide

SEQ ID NO: 420291 - DNA, 31 bp, Artificial Sequence; identical to SEQ ID NO: 72216
  Description of Artificial Sequence: Synthetic oligonucleotide

SEQ ID NO: 420292 - DNA, 21 bp, Artificial Sequence
  Description of Artificial Sequence: Synthetic oligonucleotide
ctggggcggcctgatgccgag

SEQ ID NO: 420293 - DNA, 22 bp, Artificial Sequence
  Description of Artificial Sequence: Synthetic oligonucleotide
tggggcggcctgatgccgagca

SEQ ID NO: 420294 - DNA, 21 bp, Artificial Sequence
  Description of Artificial Sequence: Synthetic oligonucleotide
ggggcggcctgatgccgagca

SEQ ID NO: 420295 - DNA, 22 bp, Artificial Sequence
  Description of Artificial Sequence: Synthetic oligonucleotide
gggcggcctgatgccgagcact

SEQ ID NO: 420296 - DNA, 22 bp, Artificial Sequence
  Description of Artificial Sequence: Synthetic oligonucleotide
ggcggcctgatgccgagcactg

SEQ ID NO: 420297 - DNA, 24 bp, Artificial Sequence
  Description of Artificial Sequence: Synthetic oligonucleotide
gcggcctgatgccgagcactggaa

SEQ ID NO: 420298 - DNA, 25 bp, Artificial Sequence
  Description of Artificial Sequence: Synthetic oligonucleotide
cggcctgatgccgagcactggaaca

SEQ ID NO: 420299 - DNA, 25 bp, Artificial Sequence
  Description of Artificial Sequence: Synthetic oligonucleotide
ggcctgatgccgagcactggaacag

SEQ ID NO: 420300 - DNA, 25 bp, Artificial Sequence
  Description of Artificial Sequence: Synthetic oligonucleotide
gcctgatgccgagcactggaacagc

SEQ ID NO: 420301 - DNA, 26 bp, Artificial Sequence
  Description of Artificial Sequence: Synthetic oligonucleotide
cctgatgccgagcactggaacagcca

SEQ ID NO: 420302 - DNA, 27 bp, Artificial Sequence
  Description of Artificial Sequence: Synthetic oligonucleotide
ctgatgccgagcactggaacagccaga

SEQ ID NO: 420303 - DNA, 28 bp, Artificial Sequence
  Description of Artificial Sequence: Synthetic oligonucleotide
tgatgccgagcactggaacagccagaag

SEQ ID NO: 420304 - DNA, 27 bp, Artificial Sequence
  Description of Artificial Sequence: Synthetic oligonucleotide
gatgccgagcactggaacagccagaag

SEQ ID NO: 420305 - DNA, 27 bp, Artificial Sequence
  Description of Artificial Sequence: Synthetic oligonucleotide
atgccgagcactggaacagccagaagg

SEQ ID NO: 420306 - DNA, 27 bp, Artificial Sequence
  Description of Artificial Sequence: Synthetic oligonucleotide
tgccgagcactggaacagccagaagga

SEQ ID NO: 420307 - DNA, 26 bp, Artificial Sequence
  Description of Artificial Sequence: Synthetic oligonucleotide
gccgagcactggaacagccagaagga

SEQ ID NO: 420308 - DNA, 26 bp, Artificial Sequence
  Description of Artificial Sequence: Synthetic oligonucleotide
ccgagcactggaacagccagaaggac

SEQ ID NO: 420309 - DNA, 27 bp, Artificial Sequence
  Description of Artificial Sequence: Synthetic oligonucleotide
cgagcactggaacagccagaaggacct

SEQ ID NO: 420310 - DNA, 26 bp, Artificial Sequence
  Description of Artificial Sequence: Synthetic oligonucleotide
aatgggacggagcgggtgcggttcat

SEQ ID NO: 420311 - DNA, 25 bp, Artificial Sequence
  Description of Artificial Sequence: Synthetic oligonucleotide
atgggacggagcgggtgcggttcat

SEQ ID NO: 420312 - DNA, 24 bp, Artificial Sequence
  Description of Artificial Sequence: Synthetic oligonucleotide
tgggacggagcgggtgcggttcat

SEQ ID NO: 420313 - DNA, 23 bp, Artificial Sequence
  Description of Artificial Sequence: Synthetic oligonucleotide
gggacggagcgggtgcggttcat

SEQ ID NO: 420314 - DNA, 23 bp, Artificial Sequence
  Description of Artificial Sequence: Synthetic oligonucleotide
ggacggagcgggtgcggttcatg

SEQ ID NO: 420315 - DNA, 24 bp, Artificial Sequence
  Description of Artificial Sequence: Synthetic oligonucleotide
gacggagcgggtgcggttcatgga

SEQ ID NO: 420316 - DNA, 25 bp, Artificial Sequence
  Description of Artificial Sequence: Synthetic oligonucleotide
acggagcgggtgcggttcatggaga

SEQ ID NO: 420317 - DNA, 24 bp, Artificial Sequence
  Description of Artificial Sequence: Synthetic oligonucleotide
cggagcgggtgcggttcatggaga

SEQ ID NO: 420318 - DNA, 27 bp, Artificial Sequence
  Description of Artificial Sequence: Synthetic oligonucleotide
ggagcgggtgcggttcatggagagata

SEQ ID NO: 420319 - DNA, 27 bp, Artificial Sequence
  Description of Artificial Sequence: Synthetic oligonucleotide
gagcgggtgcggttcatggagagatac

SEQ ID NO: 420320 - DNA, 29 bp, Artificial Sequence
  Description of Artificial Sequence: Synthetic oligonucleotide
agcgggtgcggttcatggagagatacttc

SEQ ID NO: 420321 - DNA, 28 bp, Artificial Sequence
  Description of Artificial Sequence: Synthetic oligonucleotide
gcgggtgcggttcatggagagatacttc

SEQ ID NO: 420322 - DNA, 28 bp, Artificial Sequence
  Description of Artificial Sequence: Synthetic oligonucleotide
cgggtgcggttcatggagagatacttcc

SEQ ID NO: 420323 - DNA, 32 bp, Artificial Sequence; identical to SEQ ID NO: 72248
  Description of Artificial Sequence: Synthetic oligonucleotide

SEQ ID NO: 420324 - DNA, 32 bp, Artificial Sequence; identical to SEQ ID NO: 72249
  Description of Artificial Sequence: Synthetic oligonucleotide

SEQ ID NO: 420325 - DNA, 33 bp, Artificial Sequence; identical to SEQ ID NO: 72250
  Description of Artificial Sequence: Synthetic oligonucleotide

SEQ ID NO: 420326 - DNA, 33 bp, Artificial Sequence; identical to SEQ ID NO: 72251
  Description of Artificial Sequence: Synthetic oligonucleotide

SEQ ID NO: 420327 - DNA, 32 bp, Artificial Sequence; identical to SEQ ID NO: 72252
  Description of Artificial Sequence: Synthetic oligonucleotide

SEQ ID NO: 420328 - DNA, 33 bp, Artificial Sequence; identical to SEQ ID NO: 72253
  Description of Artificial Sequence: Synthetic oligonucleotide

SEQ ID NO: 420329 - DNA, 33 bp, Artificial Sequence; identical to SEQ ID NO: 72254
  Description of Artificial Sequence: Synthetic oligonucleotide

SEQ ID NO: 420330 - DNA, 34 bp, Artificial Sequence; identical to SEQ ID NO: 72255
  Description of Artificial Sequence: Synthetic oligonucleotide

SEQ ID NO: 420331 - DNA, 36 bp, Artificial Sequence; identical to SEQ ID NO: 72256
  Description of Artificial Sequence: Synthetic oligonucleotide

SEQ ID NO: 420332 - DNA, 35 bp, Artificial Sequence; identical to SEQ ID NO: 72257
  Description of Artificial Sequence: Synthetic oligonucleotide

SEQ ID NO: 420333 - DNA, 34 bp, Artificial Sequence; identical to SEQ ID NO: 72258
  Description of Artificial Sequence: Synthetic oligonucleotide

SEQ ID NO: 420334 - DNA, 34 bp, Artificial Sequence; identical to SEQ ID NO: 72259
  Description of Artificial Sequence: Synthetic oligonucleotide

SEQ ID NO: 420335 - DNA, 21 bp, Artificial Sequence
  Description of Artificial Sequence: Synthetic oligonucleotide
tgagggagctggggcggcctg

SEQ ID NO: 420336 - DNA, 20 bp, Artificial Sequence
  Description of Artificial Sequence: Synthetic oligonucleotide
gagggagctggggcggcctg

SEQ ID NO: 420337 - DNA, 21 bp, Artificial Sequence
  Description of Artificial Sequence: Synthetic oligonucleotide
agggagctggggcggcctgct

SEQ ID NO: 420338 - DNA, 20 bp, Artificial Sequence
  Description of Artificial Sequence: Synthetic oligonucleotide
gggagctggggcggcctgct

SEQ ID NO: 420339 - DNA, 22 bp, Artificial Sequence
  Description of Artificial Sequence: Synthetic oligonucleotide
tggagcggaggcgggccgagat

SEQ ID NO: 420340 - DNA, 21 bp, Artificial Sequence
  Description of Artificial Sequence: Synthetic oligonucleotide
ggagcggaggcgggccgagat

SEQ ID NO: 420341 - DNA, 21 bp, Artificial Sequence
  Description of Artificial Sequence: Synthetic oligonucleotide
gagcggaggcgggccgagatg

SEQ ID NO: 420342 - DNA, 22 bp, Artificial Sequence
  Description of Artificial Sequence: Synthetic oligonucleotide
agcggaggcgggccgagatgga

SEQ ID NO: 420343 - DNA, 21 bp, Artificial Sequence
  Description of Artificial Sequence: Synthetic oligonucleotide
gcggaggcgggccgagatgga

SEQ ID NO: 420344 - DNA, 22 bp, Artificial Sequence
  Description of Artificial Sequence: Synthetic oligonucleotide
cggaggcgggccgagatggaca

SEQ ID NO: 420345 - DNA, 22 bp, Artificial Sequence
  Description of Artificial Sequence: Synthetic oligonucleotide
ggaggcgggccgagatggacac

SEQ ID NO: 420346 - DNA, 26 bp, Artificial Sequence
  Description of Artificial Sequence: Synthetic oligonucleotide
gaggcgggccgagatggacacctatt

SEQ ID NO: 420347 - DNA, 26 bp, Artificial Sequence
  Description of Artificial Sequence: Synthetic oligonucleotide
aggcgggccgagatggacacctattg

SEQ ID NO: 420348 - DNA, 25 bp, Artificial Sequence
  Description of Artificial Sequence: Synthetic oligonucleotide
ggcgggccgagatggacacctattg

SEQ ID NO: 420349 - DNA, 26 bp, Artificial Sequence
  Description of Artificial Sequence: Synthetic oligonucleotide
gcgggccgagatggacacctattgca

SEQ ID NO: 420350 - DNA, 27 bp, Artificial Sequence
  Description of Artificial Sequence: Synthetic oligonucleotide
cgggccgagatggacacctattgcaga

SEQ ID NO: 420351 - DNA, 27 bp, Artificial Sequence
  Description of Artificial Sequence: Synthetic oligonucleotide
gggccgagatggacacctattgcagac

SEQ ID NO: 420352 - DNA, 28 bp, Artificial Sequence
  Description of Artificial Sequence: Synthetic oligonucleotide
ggccgagatggacacctattgcagacac

SEQ ID NO: 420353 - DNA, 30 bp, Artificial Sequence; identical to SEQ ID NO: 72278
  Description of Artificial Sequence: Synthetic oligonucleotide

SEQ ID NO: 420354 - DNA, 32 bp, Artificial Sequence; identical to SEQ ID NO: 72279
  Description of Artificial Sequence: Synthetic oligonucleotide

SEQ ID NO: 420355 - DNA, 32 bp, Artificial Sequence; identical to SEQ ID NO: 72280
  Description of Artificial Sequence: Synthetic oligonucleotide

SEQ ID NO: 420356 - DNA, 32 bp, Artificial Sequence; identical to SEQ ID NO: 72281
  Description of Artificial Sequence: Synthetic oligonucleotide

SEQ ID NO: 420357 - DNA, 32 bp, Artificial Sequence; identical to SEQ ID NO: 72282
  Description of Artificial Sequence: Synthetic oligonucleotide

SEQ ID NO: 420358 - DNA, 31 bp, Artificial Sequence; identical to SEQ ID NO: 72283
  Description of Artificial Sequence: Synthetic oligonucleotide

SEQ ID NO: 420359 - DNA, 31 bp, Artificial Sequence; identical to SEQ ID NO: 72284
  Description of Artificial Sequence: Synthetic oligonucleotide

SEQ ID NO: 420360 - DNA, 22 bp, Artificial Sequence
  Description of Artificial Sequence: Synthetic oligonucleotide
gtgacggagctggggcagcctg

SEQ ID NO: 420361 - DNA, 23 bp, Artificial Sequence
  Description of Artificial Sequence: Synthetic oligonucleotide
tgacggagctggggcagcctgct

SEQ ID NO: 420362 - DNA, 22 bp, Artificial Sequence
  Description of Artificial Sequence: Synthetic oligonucleotide
gacggagctggggcagcctgct

SEQ ID NO: 420363 - DNA, 22 bp, Artificial Sequence
  Description of Artificial Sequence: Synthetic oligonucleotide
acggagctggggcagcctgctg

SEQ ID NO: 420364 - DNA, 21 bp, Artificial Sequence
  Description of Artificial Sequence: Synthetic oligonucleotide
cggagctggggcagcctgctg

SEQ ID NO: 420365 - DNA, 21 bp, Artificial Sequence
  Description of Artificial Sequence: Synthetic oligonucleotide
ggagctggggcagcctgctgc

SEQ ID NO: 420366 - DNA, 21 bp, Artificial Sequence
  Description of Artificial Sequence: Synthetic oligonucleotide
gagctggggcagcctgctgcg

SEQ ID NO: 420367 - DNA, 22 bp, Artificial Sequence
  Description of Artificial Sequence: Synthetic oligonucleotide
agctggggcagcctgctgcgga

SEQ ID NO: 420368 - DNA, 21 bp, Artificial Sequence
  Description of Artificial Sequence: Synthetic oligonucleotide
gctggggcagcctgctgcgga

SEQ ID NO: 420369 - DNA, 21 bp, Artificial Sequence
  Description of Artificial Sequence: Synthetic oligonucleotide
ctggggcagcctgctgcggag

SEQ ID NO: 420370 - DNA, 22 bp, Artificial Sequence
  Description of Artificial Sequence: Synthetic oligonucleotide
tggggcagcctgctgcggagca

SEQ ID NO: 420371 - DNA, 21 bp, Artificial Sequence
  Description of Artificial Sequence: Synthetic oligonucleotide
ggggcagcctgctgcggagca

SEQ ID NO: 420372 - DNA, 22 bp, Artificial Sequence
  Description of Artificial Sequence: Synthetic oligonucleotide
gggcagcctgctgcggagcact

SEQ ID NO: 420373 - DNA, 22 bp, Artificial Sequence
  Description of Artificial Sequence: Synthetic oligonucleotide
ggcagcctgctgcggagcactg

SEQ ID NO: 420374 - DNA, 24 bp, Artificial Sequence
  Description of Artificial Sequence: Synthetic oligonucleotide
gcagcctgctgcggagcactggaa

SEQ ID NO: 420375 - DNA, 25 bp, Artificial Sequence
  Description of Artificial Sequence: Synthetic oligonucleotide
cagcctgctgcggagcactggaaca

SEQ ID NO: 420376 - DNA, 25 bp, Artificial Sequence
  Description of Artificial Sequence: Synthetic oligonucleotide
agcctgctgcggagcactggaacag

SEQ ID NO: 420377 - DNA, 20 bp, Artificial Sequence
  Description of Artificial Sequence: Synthetic oligonucleotide
ggcggtgacggagctggggg

SEQ ID NO: 420378 - DNA, 20 bp, Artificial Sequence
  Description of Artificial Sequence: Synthetic oligonucleotide
gcggtgacggagctgggggg

SEQ ID NO: 420379 - DNA, 20 bp, Artificial Sequence
  Description of Artificial Sequence: Synthetic oligonucleotide
cggtgacggagctggggggg

SEQ ID NO: 420380 - DNA, 20 bp, Artificial Sequence
  Description of Artificial Sequence: Synthetic oligonucleotide
ggtgacggagctgggggggc

SEQ ID NO: 420381 - DNA, 21 bp, Artificial Sequence
  Description of Artificial Sequence: Synthetic oligonucleotide
gtgacggagctgggggggcct

SEQ ID NO: 420382 - DNA, 21 bp, Artificial Sequence
  Description of Artificial Sequence: Synthetic oligonucleotide
tgacggagctgggggggcctg

SEQ ID NO: 420383 - DNA, 20 bp, Artificial Sequence
  Description of Artificial Sequence: Synthetic oligonucleotide
gacggagctgggggggcctg

SEQ ID NO: 420384 - DNA, 21 bp, Artificial Sequence
  Description of Artificial Sequence: Synthetic oligonucleotide
acggagctgggggggcctgct

SEQ ID NO: 420385 - DNA, 20 bp, Artificial Sequence
  Description of Artificial Sequence: Synthetic oligonucleotide
cggagctgggggggcctgct

SEQ ID NO: 420386 - DNA, 20 bp, Artificial Sequence
  Description of Artificial Sequence: Synthetic oligonucleotide
ggagctgggggggcctgctg

SEQ ID NO: 420387 - DNA, 20 bp, Artificial Sequence
  Description of Artificial Sequence: Synthetic oligonucleotide
gagctgggggggcctgctgc

SEQ ID NO: 420388 - DNA, 20 bp, Artificial Sequence
  Description of Artificial Sequence: Synthetic oligonucleotide
agctgggggggcctgctgcg

SEQ ID NO: 420389 - DNA, 20 bp, Artificial Sequence
  Description of Artificial Sequence: Synthetic oligonucleotide
gctgggggggcctgctgcgt

SEQ ID NO: 420390 - DNA, 20 bp, Artificial Sequence
  Description of Artificial Sequence: Synthetic oligonucleotide
ctgggggggcctgctgcgga

SEQ ID NO: 420391 - DNA, 20 bp, Artificial Sequence
  Description of Artificial Sequence: Synthetic oligonucleotide
tgggggggcctgctgcggag

SEQ ID NO: 420392 - DNA, 20 bp, Artificial Sequence
  Description of Artificial Sequence: Synthetic oligonucleotide
gggggggcctgctgcggagt

SEQ ID NO: 420393 - DNA, 20 bp, Artificial Sequence
  Description of Artificial Sequence: Synthetic oligonucleotide
ggggggcctgctgcggagca

SEQ ID NO: 420394 - DNA, 21 bp, Artificial Sequence
  Description of Artificial Sequence: Synthetic oligonucleotide
gggggcctgctgcggagcact

SEQ ID NO: 420395 - DNA, 21 bp, Artificial Sequence
  Description of Artificial Sequence: Synthetic oligonucleotide
ggggcctgctgcggagcactg

SEQ ID NO: 420396 - DNA, 23 bp, Artificial Sequence
  Description of Artificial Sequence: Synthetic oligonucleotide
gggcctgctgcggagcactggaa

SEQ ID NO: 420397 - DNA, 22 bp, Artificial Sequence
  Description of Artificial Sequence: Synthetic oligonucleotide
ggaggcgggccgaggtggacaa

SEQ ID NO: 420398 - DNA, 24 bp, Artificial Sequence
  Description of Artificial Sequence: Synthetic oligonucleotide
gaggcgggccgaggtggacaacta

SEQ ID NO: 420399 - DNA, 25 bp, Artificial Sequence
  Description of Artificial Sequence: Synthetic oligonucleotide
aggcgggccgaggtggacaactact

SEQ ID NO: 420400 - DNA, 24 bp, Artificial Sequence
  Description of Artificial Sequence: Synthetic oligonucleotide
ggcgggccgaggtggacaactact

SEQ ID NO: 420401 - DNA, 24 bp, Artificial Sequence
  Description of Artificial Sequence: Synthetic oligonucleotide
gcgggccgaggtggacaactactg

SEQ ID NO: 420402 - DNA, 25 bp, Artificial Sequence
  Description of Artificial Sequence: Synthetic oligonucleotide
cgggccgaggtggacaactactgca

SEQ ID NO: 420403 - DNA, 26 bp, Artificial Sequence
  Description of Artificial Sequence: Synthetic oligonucleotide
gggccgaggtggacaactactgcaga

SEQ ID NO: 420404 - DNA, 27 bp, Artificial Sequence
  Description of Artificial Sequence: Synthetic oligonucleotide
ggccgaggtggacaactactgcagaca

SEQ ID NO: 420405 - DNA, 27 bp, Artificial Sequence
  Description of Artificial Sequence: Synthetic oligonucleotide
gccgaggtggacaactactgcagacac

SEQ ID NO: 420406 - DNA, 29 bp, Artificial Sequence
  Description of Artificial Sequence: Synthetic oligonucleotide
ccgaggtggacaactactgcagacacaac

SEQ ID NO: 420407 - DNA, 31 bp, Artificial Sequence; identical to SEQ ID NO: 72363
  Description of Artificial Sequence: Synthetic oligonucleotide

SEQ ID NO: 420408 - DNA, 31 bp, Artificial Sequence; identical to SEQ ID NO: 72364
  Description of Artificial Sequence: Synthetic oligonucleotide

SEQ ID NO: 420409 - DNA, 32 bp, Artificial Sequence; identical to SEQ ID NO: 72365
  Description of Artificial Sequence: Synthetic oligonucleotide

SEQ ID NO: 420410 - DNA, 32 bp, Artificial Sequence; identical to SEQ ID NO: 72366
  Description of Artificial Sequence: Synthetic oligonucleotide

SEQ ID NO: 420411 - DNA, 31 bp, Artificial Sequence; identical to SEQ ID NO: 72367
  Description of Artificial Sequence: Synthetic oligonucleotide

SEQ ID NO: 420412 - DNA, 31 bp, Artificial Sequence; identical to SEQ ID NO: 72368
  Description of Artificial Sequence: Synthetic oligonucleotide

SEQ ID NO: 420413 - DNA, 32 bp, Artificial Sequence; identical to SEQ ID NO: 72369
  Description of Artificial Sequence: Synthetic oligonucleotide

SEQ ID NO: 420414 - DNA, 31 bp, Artificial Sequence; identical to SEQ ID NO: 72370
  Description of Artificial Sequence: Synthetic oligonucleotide

SEQ ID NO: 420415 - DNA, 27 bp, Artificial Sequence
  Description of Artificial Sequence: Synthetic oligonucleotide
aagacaggcgggccctggtggacaatt

SEQ ID NO: 420416 - DNA, 27 bp, Artificial Sequence
  Description of Artificial Sequence: Synthetic oligonucleotide
agacaggcgggccctggtggacaatta

SEQ ID NO: 420417 - DNA, 26 bp, Artificial Sequence
  Description of Artificial Sequence: Synthetic oligonucleotide
gacaggcgggccctggtggacaatta

SEQ ID NO: 420418 - DNA, 27 bp, Artificial Sequence
  Description of Artificial Sequence: Synthetic oligonucleotide
acaggcgggccctggtggacaattact

SEQ ID NO: 420419 - DNA, 26 bp, Artificial Sequence
  Description of Artificial Sequence: Synthetic oligonucleotide
caggcgggccctggtggacaattact

SEQ ID NO: 420420 - DNA, 26 bp, Artificial Sequence
  Description of Artificial Sequence: Synthetic oligonucleotide
aggcgggccctggtggacaattactg

SEQ ID NO: 420421 - DNA, 25 bp, Artificial Sequence
  Description of Artificial Sequence: Synthetic oligonucleotide
ggcgggccctggtggacaattactg

SEQ ID NO: 420422 - DNA, 26 bp, Artificial Sequence
  Description of Artificial Sequence: Synthetic oligonucleotide
gcgggccctggtggacaattactgca

SEQ ID NO: 420423 - DNA, 27 bp, Artificial Sequence
  Description of Artificial Sequence: Synthetic oligonucleotide
cgggccctggtggacaattactgcaga

SEQ ID NO: 420424 - DNA, 27 bp, Artificial Sequence
  Description of Artificial Sequence: Synthetic oligonucleotide
gggccctggtggacaattactgcagac

SEQ ID NO: 420425 - DNA, 28 bp, Artificial Sequence
  Description of Artificial Sequence: Synthetic oligonucleotide
ggccctggtggacaattactgcagacac

SEQ ID NO: 420426 - DNA, 30 bp, Artificial Sequence; identical to SEQ ID NO: 72382
  Description of Artificial Sequence: Synthetic oligonucleotide

SEQ ID NO: 420427 - DNA, 32 bp, Artificial Sequence; identical to SEQ ID NO: 72383
  Description of Artificial Sequence: Synthetic oligonucleotide

SEQ ID NO: 420428 - DNA, 32 bp, Artificial Sequence; identical to SEQ ID NO: 72384
  Description of Artificial Sequence: Synthetic oligonucleotide

SEQ ID NO: 420429 - DNA, 32 bp, Artificial Sequence; identical to SEQ ID NO: 72385
  Description of Artificial Sequence: Synthetic oligonucleotide

SEQ ID NO: 420430 - DNA, 32 bp, Artificial Sequence; identical to SEQ ID NO: 72386
  Description of Artificial Sequence: Synthetic oligonucleotide

SEQ ID NO: 420431 - DNA, 27 bp, Artificial Sequence
  Description of Artificial Sequence: Synthetic oligonucleotide
tggtgctgagctccccactggctttgt

SEQ ID NO: 420432 - DNA, 26 bp, Artificial Sequence
  Description of Artificial Sequence: Synthetic oligonucleotide
ggtgctgagctccccactggctttgt

SEQ ID NO: 420433 - DNA, 27 bp, Artificial Sequence
  Description of Artificial Sequence: Synthetic oligonucleotide
gtgctgagctccccactggctttgtct

SEQ ID NO: 420434 - DNA, 27 bp, Artificial Sequence
  Description of Artificial Sequence: Synthetic oligonucleotide
tgctgagctccccactggctttgtctg

SEQ ID NO: 420435 - DNA, 26 bp, Artificial Sequence
  Description of Artificial Sequence: Synthetic oligonucleotide
gctgagctccccactggctttgtctg

SEQ ID NO: 420436 - DNA, 26 bp, Artificial Sequence
  Description of Artificial Sequence: Synthetic oligonucleotide
ctgagctccccactggctttgtctgg

SEQ ID NO: 420437 - DNA, 26 bp, Artificial Sequence
  Description of Artificial Sequence: Synthetic oligonucleotide
tgagctccccactggctttgtctggg

SEQ ID NO: 420438 - DNA, 25 bp, Artificial Sequence
  Description of Artificial Sequence: Synthetic oligonucleotide
gagctccccactggctttgtctggg

SEQ ID NO: 420439 - DNA, 26 bp, Artificial Sequence
  Description of Artificial Sequence: Synthetic oligonucleotide
agctccccactggctttgtctgggga

SEQ ID NO: 420440 - DNA, 25 bp, Artificial Sequence
  Description of Artificial Sequence: Synthetic oligonucleotide
gctccccactggctttgtctgggga

SEQ ID NO: 420441 - DNA, 26 bp, Artificial Sequence
  Description of Artificial Sequence: Synthetic oligonucleotide
ctccccactggctttgtctggggaca

SEQ ID NO: 420442 - DNA, 26 bp, Artificial Sequence
  Description of Artificial Sequence: Synthetic oligonucleotide
tccccactggctttgtctggggacac

SEQ ID NO: 420443 - DNA, 25 bp, Artificial Sequence
  Description of Artificial Sequence: Synthetic oligonucleotide
ccccactggctttgtctggggacac

SEQ ID NO: 420444 - DNA, 25 bp, Artificial Sequence
  Description of Artificial Sequence: Synthetic oligonucleotide
cccactggctttgtctggggacacc

SEQ ID NO: 420445 - DNA, 25 bp, Artificial Sequence
  Description of Artificial Sequence: Synthetic oligonucleotide
ccactggctttgtctggggacaccc

SEQ ID NO: 420446 - DNA, 26 bp, Artificial Sequence
  Description of Artificial Sequence: Synthetic oligonucleotide
cactggctttgtctggggacacccga

SEQ ID NO: 420447 - DNA, 26 bp, Artificial Sequence
  Description of Artificial Sequence: Synthetic oligonucleotide
actggctttgtctggggacacccgac

SEQ ID NO: 420448 - DNA, 25 bp, Artificial Sequence
  Description of Artificial Sequence: Synthetic oligonucleotide
ctggctttgtctggggacacccgac

SEQ ID NO: 420449 - DNA, 26 bp, Artificial Sequence
  Description of Artificial Sequence: Synthetic oligonucleotide
tggctttgtctggggacacccgacca

SEQ ID NO: 420450 - DNA, 25 bp, Artificial Sequence
  Description of Artificial Sequence: Synthetic oligonucleotide
ggctttgtctggggacacccgacca

SEQ ID NO: 420451 - DNA, 25 bp, Artificial Sequence
  Description of Artificial Sequence: Synthetic oligonucleotide
gctttgtctggggacacccgaccac

SEQ ID NO: 420452 - DNA, 27 bp, Artificial Sequence
  Description of Artificial Sequence: Synthetic oligonucleotide
ctttgtctggggacacccgaccacgtt

SEQ ID NO: 420453 - DNA, 28 bp, Artificial Sequence
  Description of Artificial Sequence: Synthetic oligonucleotide
tttgtctggggacacccgaccacgtttc

SEQ ID NO: 420454 - DNA, 27 bp, Artificial Sequence
  Description of Artificial Sequence: Synthetic oligonucleotide
ttgtctggggacacccgaccacgtttc

SEQ ID NO: 420455 - DNA, 26 bp, Artificial Sequence
  Description of Artificial Sequence: Synthetic oligonucleotide
tgtctggggacacccgaccacgtttc

SEQ ID NO: 420456 - DNA, 25 bp, Artificial Sequence
  Description of Artificial Sequence: Synthetic oligonucleotide
gtctggggacacccgaccacgtttc

SEQ ID NO: 420457 - DNA, 26 bp, Artificial Sequence
  Description of Artificial Sequence: Synthetic oligonucleotide
tctggggacacccgaccacgtttcct

SEQ ID NO: 420458 - DNA, 25 bp, Artificial Sequence
  Description of Artificial Sequence: Synthetic oligonucleotide
ctggggacacccgaccacgtttcct

SEQ ID NO: 420459 - DNA, 26 bp, Artificial Sequence
  Description of Artificial Sequence: Synthetic oligonucleotide
tggggacacccgaccacgtttcctgt

SEQ ID NO: 420460 - DNA, 25 bp, Artificial Sequence
  Description of Artificial Sequence: Synthetic oligonucleotide
ggggacacccgaccacgtttcctgt

SEQ ID NO: 420461 - DNA, 25 bp, Artificial Sequence
  Description of Artificial Sequence: Synthetic oligonucleotide
gggacacccgaccacgtttcctgtg

SEQ ID NO: 420462 - DNA, 25 bp, Artificial Sequence
  Description of Artificial Sequence: Synthetic oligonucleotide
ggacacccgaccacgtttcctgtgg

SEQ ID NO: 420463 - DNA, 26 bp, Artificial Sequence
  Description of Artificial Sequence: Synthetic oligonucleotide
gacacccgaccacgtttcctgtggca

SEQ ID NO: 420464 - DNA, 26 bp, Artificial Sequence
  Description of Artificial Sequence: Synthetic oligonucleotide
acacccgaccacgtttcctgtggcag

SEQ ID NO: 420465 - DNA, 25 bp, Artificial Sequence
  Description of Artificial Sequence: Synthetic oligonucleotide
cacccgaccacgtttcctgtggcag

SEQ ID NO: 420466 - DNA, 25 bp, Artificial Sequence
  Description of Artificial Sequence: Synthetic oligonucleotide
acccgaccacgtttcctgtggcagc

SEQ ID NO: 420467 - DNA, 24 bp, Artificial Sequence
  Description of Artificial Sequence: Synthetic oligonucleotide
cccgaccacgtttcctgtggcagc

SEQ ID NO: 420468 - DNA, 27 bp, Artificial Sequence
  Description of Artificial Sequence: Synthetic oligonucleotide
ccgaccacgtttcctgtggcagcctaa

SEQ ID NO: 420469 - DNA, 27 bp, Artificial Sequence
  Description of Artificial Sequence: Synthetic oligonucleotide
cgaccacgtttcctgtggcagcctaag

SEQ ID NO: 420470 - DNA, 28 bp, Artificial Sequence
  Description of Artificial Sequence: Synthetic oligonucleotide
gaccacgtttcctgtggcagcctaagag

SEQ ID NO: 420471 - DNA, 28 bp, Artificial Sequence
  Description of Artificial Sequence: Synthetic oligonucleotide
accacgtttcctgtggcagcctaagagg

SEQ ID NO: 420472 - DNA, 27 bp, Artificial Sequence
  Description of Artificial Sequence: Synthetic oligonucleotide
ccacgtttcctgtggcagcctaagagg

SEQ ID NO: 420473 - DNA, 27 bp, Artificial Sequence
  Description of Artificial Sequence: Synthetic oligonucleotide
cacgtttcctgtggcagcctaagaggg

SEQ ID NO: 420474 - DNA, 28 bp, Artificial Sequence
  Description of Artificial Sequence: Synthetic oligonucleotide
acgtttcctgtggcagcctaagagggag

SEQ ID NO: 420475 - DNA, 27 bp, Artificial Sequence
  Description of Artificial Sequence: Synthetic oligonucleotide
cgtttcctgtggcagcctaagagggag

SEQ ID NO: 420476 - DNA, 28 bp, Artificial Sequence
  Description of Artificial Sequence: Synthetic oligonucleotide
gtttcctgtggcagcctaagagggagtg

SEQ ID NO: 420477 - DNA, 29 bp, Artificial Sequence
  Description of Artificial Sequence: Synthetic oligonucleotide
tttcctgtggcagcctaagagggagtgtc

SEQ ID NO: 420478 - DNA, 28 bp, Artificial Sequence
  Description of Artificial Sequence: Synthetic oligonucleotide
ttcctgtggcagcctaagagggagtgtc

SEQ ID NO: 420479 - DNA, 27 bp, Artificial Sequence
  Description of Artificial Sequence: Synthetic oligonucleotide
tcctgtggcagcctaagagggagtgtc

SEQ ID NO: 420480 - DNA, 27 bp, Artificial Sequence
  Description of Artificial Sequence: Synthetic oligonucleotide
cctgtggcagcctaagagggagtgtca

SEQ ID NO: 420481 - DNA, 30 bp, Artificial Sequence; identical to SEQ ID NO: 72437
  Description of Artificial Sequence: Synthetic oligonucleotide

SEQ ID NO: 420482 - DNA, 32 bp, Artificial Sequence; identical to SEQ ID NO: 72438
  Description of Artificial Sequence: Synthetic oligonucleotide

SEQ ID NO: 420483 - DNA, 31 bp, Artificial Sequence; identical to SEQ ID NO: 72439
  Description of Artificial Sequence: Synthetic oligonucleotide

SEQ ID NO: 420484 - DNA, 34 bp, Artificial Sequence; identical to SEQ ID NO: 72440
  Description of Artificial Sequence: Synthetic oligonucleotide

SEQ ID NO: 420485 - DNA, 33 bp, Artificial Sequence; identical to SEQ ID NO: 72441
  Description of Artificial Sequence: Synthetic oligonucleotide

SEQ ID NO: 420486 - DNA, 33 bp, Artificial Sequence; identical to SEQ ID NO: 72442
  Description of Artificial Sequence: Synthetic oligonucleotide

SEQ ID NO: 420487 - DNA, 33 bp, Artificial Sequence; identical to SEQ ID NO: 72443
  Description of Artificial Sequence: Synthetic oligonucleotide

SEQ ID NO: 420488 - DNA, 34 bp, Artificial Sequence; identical to SEQ ID NO: 72444
  Description of Artificial Sequence: Synthetic oligonucleotide

SEQ ID NO: 420489 - DNA, 33 bp, Artificial Sequence; identical to SEQ ID NO: 72445
  Description of Artificial Sequence: Synthetic oligonucleotide

SEQ ID NO: 420490 - DNA, 33 bp, Artificial Sequence; identical to SEQ ID NO: 72446
  Description of Artificial Sequence: Synthetic oligonucleotide

SEQ ID NO: 420491 - DNA, 33 bp, Artificial Sequence; identical to SEQ ID NO: 72447
  Description of Artificial Sequence: Synthetic oligonucleotide

SEQ ID NO: 420492 - DNA, 34 bp, Artificial Sequence; identical to SEQ ID NO: 72448
  Description of Artificial Sequence: Synthetic oligonucleotide

SEQ ID NO: 420493 - DNA, 33 bp, Artificial Sequence; identical to SEQ ID NO: 72449
  Description of Artificial Sequence: Synthetic oligonucleotide

SEQ ID NO: 420494 - DNA, 32 bp, Artificial Sequence; identical to SEQ ID NO: 72450
  Description of Artificial Sequence: Synthetic oligonucleotide

SEQ ID NO: 420495 - DNA, 31 bp, Artificial Sequence; identical to SEQ ID NO: 72451
  Description of Artificial Sequence: Synthetic oligonucleotide

SEQ ID NO: 420496 - DNA, 31 bp, Artificial Sequence; identical to SEQ ID NO: 72452
  Description of Artificial Sequence: Synthetic oligonucleotide

SEQ ID NO: 420497 - DNA, 30 bp, Artificial Sequence; identical to SEQ ID NO: 72453
  Description of Artificial Sequence: Synthetic oligonucleotide

SEQ ID NO: 420498 - DNA, 30 bp, Artificial Sequence; identical to SEQ ID NO: 72454
  Description of Artificial Sequence: Synthetic oligonucleotide

SEQ ID NO: 420499 - DNA, 27 bp, Artificial Sequence
  Description of Artificial Sequence: Synthetic oligonucleotide
agcttcacagtgcagcggcgagtccaa

SEQ ID NO: 420500 - DNA, 26 bp, Artificial Sequence
  Description of Artificial Sequence: Synthetic oligonucleotide
gcttcacagtgcagcggcgagtccaa

SEQ ID NO: 420501 - DNA, 26 bp, Artificial Sequence
  Description of Artificial Sequence: Synthetic oligonucleotide
cttcacagtgcagcggcgagtccaac

SEQ ID NO: 420502 - DNA, 27 bp, Artificial Sequence
  Description of Artificial Sequence: Synthetic oligonucleotide
ttcacagtgcagcggcgagtccaacct

SEQ ID NO: 420503 - DNA, 27 bp, Artificial Sequence
  Description of Artificial Sequence: Synthetic oligonucleotide
tcacagtgcagcggcgagtccaaccta

SEQ ID NO: 420504 - DNA, 27 bp, Artificial Sequence
  Description of Artificial Sequence: Synthetic oligonucleotide
cacagtgcagcggcgagtccaacctaa

SEQ ID NO: 420505 - DNA, 27 bp, Artificial Sequence
  Description of Artificial Sequence: Synthetic oligonucleotide
acagtgcagcggcgagtccaacctaag

SEQ ID NO: 420506 - DNA, 26 bp, Artificial Sequence
  Description of Artificial Sequence: Synthetic oligonucleotide
cagtgcagcggcgagtccaacctaag

SEQ ID NO: 420507 - DNA, 27 bp, Artificial Sequence
  Description of Artificial Sequence: Synthetic oligonucleotide
agtgcagcggcgagtccaacctaaggt

SEQ ID NO: 420508 - DNA, 26 bp, Artificial Sequence
  Description of Artificial Sequence: Synthetic oligonucleotide
gtgcagcggcgagtccaacctaaggt

SEQ ID NO: 420509 - DNA, 27 bp, Artificial Sequence
  Description of Artificial Sequence: Synthetic oligonucleotide
tgcagcggcgagtccaacctaaggtga

SEQ ID NO: 420510 - DNA, 26 bp, Artificial Sequence
  Description of Artificial Sequence: Synthetic oligonucleotide
gcagcggcgagtccaacctaaggtga

SEQ ID NO: 420511 - DNA, 27 bp, Artificial Sequence
  Description of Artificial Sequence: Synthetic oligonucleotide
cagcggcgagtccaacctaaggtgact

SEQ ID NO: 420512 - DNA, 27 bp, Artificial Sequence
  Description of Artificial Sequence: Synthetic oligonucleotide
agcggcgagtccaacctaaggtgactg

SEQ ID NO: 420513 - DNA, 27 bp, Artificial Sequence
  Description of Artificial Sequence: Synthetic oligonucleotide
gcggcgagtccaacctaaggtgactgt

SEQ ID NO: 420514 - DNA, 31 bp, Artificial Sequence; identical to SEQ ID NO: 72470
  Description of Artificial Sequence: Synthetic oligonucleotide

SEQ ID NO: 420515 - DNA, 31 bp, Artificial Sequence; identical to SEQ ID NO: 72471
  Description of Artificial Sequence: Synthetic oligonucleotide

SEQ ID NO: 420516 - DNA, 33 bp, Artificial Sequence; identical to SEQ ID NO: 72472
  Description of Artificial Sequence: Synthetic oligonucleotide

SEQ ID NO: 420517 - DNA, 36 bp, Artificial Sequence; identical to SEQ ID NO: 72473
  Description of Artificial Sequence: Synthetic oligonucleotide

SEQ ID NO: 420518 - DNA, 37 bp, Artificial Sequence; identical to SEQ ID NO: 72474
  Description of Artificial Sequence: Synthetic oligonucleotide

SEQ ID NO: 420519 - DNA, 37 bp, Artificial Sequence; identical to SEQ ID NO: 72475
  Description of Artificial Sequence: Synthetic oligonucleotide

SEQ ID NO: 420520 - DNA, 36 bp, Artificial Sequence; identical to SEQ ID NO: 72476
  Description of Artificial Sequence: Synthetic oligonucleotide

SEQ ID NO: 420521 - DNA, 36 bp, Artificial Sequence; identical to SEQ ID NO: 72477
  Description of Artificial Sequence: Synthetic oligonucleotide

SEQ ID NO: 420522 - DNA, 35 bp, Artificial Sequence; identical to SEQ ID NO: 72478
  Description of Artificial Sequence: Synthetic oligonucleotide

SEQ ID NO: 420523 - DNA, 36 bp, Artificial Sequence; identical to SEQ ID NO: 72479
  Description of Artificial Sequence: Synthetic oligonucleotide

SEQ ID NO: 420524 - DNA, 36 bp, Artificial Sequence; identical to SEQ ID NO: 72480
  Description of Artificial Sequence: Synthetic oligonucleotide

SEQ ID NO: 420525 - DNA, 35 bp, Artificial Sequence; identical to SEQ ID NO: 72481
  Description of Artificial Sequence: Synthetic oligonucleotide

SEQ ID NO: 420526 - DNA, 34 bp, Artificial Sequence; identical to SEQ ID NO: 72482
  Description of Artificial Sequence: Synthetic oligonucleotide

SEQ ID NO: 420527 - DNA, 34 bp, Artificial Sequence; identical to SEQ ID NO: 72483
  Description of Artificial Sequence: Synthetic oligonucleotide

SEQ ID NO: 420528 - DNA, 34 bp, Artificial Sequence; identical to SEQ ID NO: 72484
  Description of Artificial Sequence: Synthetic oligonucleotide

SEQ ID NO: 420529 - DNA, 33 bp, Artificial Sequence; identical to SEQ ID NO: 72485
  Description of Artificial Sequence: Synthetic oligonucleotide

SEQ ID NO: 420530 - DNA, 32 bp, Artificial Sequence; identical to SEQ ID NO: 72486
  Description of Artificial Sequence: Synthetic oligonucleotide

SEQ ID NO: 420531 - DNA, 31 bp, Artificial Sequence; identical to SEQ ID NO: 72487
  Description of Artificial Sequence: Synthetic oligonucleotide

SEQ ID NO: 420532 - DNA, 31 bp, Artificial Sequence; identical to SEQ ID NO: 72488
  Description of Artificial Sequence: Synthetic oligonucleotide

SEQ ID NO: 420533 - DNA, 32 bp, Artificial Sequence; identical to SEQ ID NO: 72489
  Description of Artificial Sequence: Synthetic oligonucleotide

SEQ ID NO: 420534 - DNA, 31 bp, Artificial Sequence; identical to SEQ ID NO: 72490
  Description of Artificial Sequence: Synthetic oligonucleotide

SEQ ID NO: 420535 - DNA, 31 bp, Artificial Sequence; identical to SEQ ID NO: 72491
  Description of Artificial Sequence: Synthetic oligonucleotide

SEQ ID NO: 420536 - DNA, 30 bp, Artificial Sequence; identical to SEQ ID NO: 72492
  Description of Artificial Sequence: Synthetic oligonucleotide

SEQ ID NO: 420537 - DNA, 31 bp, Artificial Sequence; identical to SEQ ID NO: 72493
  Description of Artificial Sequence: Synthetic oligonucleotide

SEQ ID NO: 420538 - DNA, 30 bp, Artificial Sequence; identical to SEQ ID NO: 72494
  Description of Artificial Sequence: Synthetic oligonucleotide

SEQ ID NO: 420539 - DNA, 30 bp, Artificial Sequence; identical to SEQ ID NO: 72495
  Description of Artificial Sequence: Synthetic oligonucleotide

SEQ ID NO: 420540 - DNA, 29 bp, Artificial Sequence
  Description of Artificial Sequence: Synthetic oligonucleotide
atatccttcaaagacccagcccctgcagc

SEQ ID NO: 420541 - DNA, 29 bp, Artificial Sequence
  Description of Artificial Sequence: Synthetic oligonucleotide
caggcagcattgaagtcaggtggttcctg

SEQ ID NO: 420542 - DNA, 31 bp, Artificial Sequence; identical to SEQ ID NO: 72498
  Description of Artificial Sequence: Synthetic oligonucleotide

SEQ ID NO: 420543 - DNA, 30 bp, Artificial Sequence; identical to SEQ ID NO: 72499
  Description of Artificial Sequence: Synthetic oligonucleotide

SEQ ID NO: 420544 - DNA, 30 bp, Artificial Sequence; identical to SEQ ID NO: 72500
  Description of Artificial Sequence: Synthetic oligonucleotide

SEQ ID NO: 420545 - DNA, 30 bp, Artificial Sequence; identical to SEQ ID NO: 72501
  Description of Artificial Sequence: Synthetic oligonucleotide

SEQ ID NO: 420546 - DNA, 30 bp, Artificial Sequence; identical to SEQ ID NO: 72502
  Description of Artificial Sequence: Synthetic oligonucleotide

SEQ ID NO: 420547 - DNA, 29 bp, Artificial Sequence
  Description of Artificial Sequence: Synthetic oligonucleotide
gcattgaagtcaggtggttcctgaacggc

SEQ ID NO: 420548 - DNA, 29 bp, Artificial Sequence
  Description of Artificial Sequence: Synthetic oligonucleotide
cattgaagtcaggtggttcctgaacggcc

SEQ ID NO: 420549 - DNA, 30 bp, Artificial Sequence; identical to SEQ ID NO: 72505
  Description of Artificial Sequence: Synthetic oligonucleotide

SEQ ID NO: 420550 - DNA, 29 bp, Artificial Sequence
  Description of Artificial Sequence: Synthetic oligonucleotide
ttgaagtcaggtggttcctgaacggccag

SEQ ID NO: 420551 - DNA, 28 bp, Artificial Sequence
  Description of Artificial Sequence: Synthetic oligonucleotide
tgaagtcaggtggttcctgaacggccag

SEQ ID NO: 420552 - DNA, 27 bp, Artificial Sequence
  Description of Artificial Sequence: Synthetic oligonucleotide
gaagtcaggtggttcctgaacggccag

SEQ ID NO: 420553 - DNA, 27 bp, Artificial Sequence
  Description of Artificial Sequence: Synthetic oligonucleotide
aagtcaggtggttcctgaacggccagg

SEQ ID NO: 420554 - DNA, 27 bp, Artificial Sequence
  Description of Artificial Sequence: Synthetic oligonucleotide
agtcaggtggttcctgaacggccagga

SEQ ID NO: 420555 - DNA, 27 bp, Artificial Sequence
  Description of Artificial Sequence: Synthetic oligonucleotide
gtcaggtggttcctgaacggccaggaa

SEQ ID NO: 420556 - DNA, 27 bp, Artificial Sequence
  Description of Artificial Sequence: Synthetic oligonucleotide
tcaggtggttcctgaacggccaggaag

SEQ ID NO: 420557 - DNA, 27 bp, Artificial Sequence
  Description of Artificial Sequence: Synthetic oligonucleotide
caggtggttcctgaacggccaggaaga

SEQ ID NO: 420558 - DNA, 27 bp, Artificial Sequence
  Description of Artificial Sequence: Synthetic oligonucleotide
aggtggttcctgaacggccaggaagag

SEQ ID NO: 420559 - DNA, 27 bp, Artificial Sequence
  Description of Artificial Sequence: Synthetic oligonucleotide
ggtggttcctgaacggccaggaagaga

SEQ ID NO: 420560 - DNA, 28 bp, Artificial Sequence
  Description of Artificial Sequence: Synthetic oligonucleotide
gtggttcctgaacggccaggaagagaag

SEQ ID NO: 420561 - DNA, 28 bp, Artificial Sequence
  Description of Artificial Sequence: Synthetic oligonucleotide
tggttcctgaacggccaggaagagaagg

SEQ ID NO: 420562 - DNA, 27 bp, Artificial Sequence
  Description of Artificial Sequence: Synthetic oligonucleotide
ggttcctgaacggccaggaagagaagg

SEQ ID NO: 420563 - DNA, 27 bp, Artificial Sequence
  Description of Artificial Sequence: Synthetic oligonucleotide
gttcctgaacggccaggaagagaaggc

SEQ ID NO: 420564 - DNA, 28 bp, Artificial Sequence
  Description of Artificial Sequence: Synthetic oligonucleotide
ttcctgaacggccaggaagagaaggctg

SEQ ID NO: 420565 - DNA, 27 bp, Artificial Sequence
  Description of Artificial Sequence: Synthetic oligonucleotide
tcctgaacggccaggaagagaaggctg

SEQ ID NO: 420566 - DNA, 26 bp, Artificial Sequence
  Description of Artificial Sequence: Synthetic oligonucleotide
cctgaacggccaggaagagaaggctg

SEQ ID NO: 420567 - DNA, 26 bp, Artificial Sequence
  Description of Artificial Sequence: Synthetic oligonucleotide
ctgaacggccaggaagagaaggctgg

SEQ ID NO: 420568 - DNA, 27 bp, Artificial Sequence
  Description of Artificial Sequence: Synthetic oligonucleotide
tgaacggccaggaagagaaggctggga

SEQ ID NO: 420569 - DNA, 27 bp, Artificial Sequence
  Description of Artificial Sequence: Synthetic oligonucleotide
gaacggccaggaagagaaggctgggat

SEQ ID NO: 420570 - DNA, 27 bp, Artificial Sequence
  Description of Artificial Sequence: Synthetic oligonucleotide
aacggccaggaagagaaggctgggatg

SEQ ID NO: 420571 - DNA, 26 bp, Artificial Sequence
  Description of Artificial Sequence: Synthetic oligonucleotide
acggccaggaagagaaggctgggatg

SEQ ID NO: 420572 - DNA, 25 bp, Artificial Sequence
  Description of Artificial Sequence: Synthetic oligonucleotide
cggccaggaagagaaggctgggatg

SEQ ID NO: 420573 - DNA, 26 bp, Artificial Sequence
  Description of Artificial Sequence: Synthetic oligonucleotide
ggccaggaagagaaggctgggatggt

SEQ ID NO: 420574 - DNA, 27 bp, Artificial Sequence
  Description of Artificial Sequence: Synthetic oligonucleotide
gccaggaagagaaggctgggatggtgt

SEQ ID NO: 420575 - DNA, 27 bp, Artificial Sequence
  Description of Artificial Sequence: Synthetic oligonucleotide
ccaggaagagaaggctgggatggtgtc

SEQ ID NO: 420576 - DNA, 27 bp, Artificial Sequence
  Description of Artificial Sequence: Synthetic oligonucleotide
caggaagagaaggctgggatggtgtcc

SEQ ID NO: 420577 - DNA, 28 bp, Artificial Sequence
  Description of Artificial Sequence: Synthetic oligonucleotide
aggaagagaaggctgggatggtgtccac

SEQ ID NO: 420578 - DNA, 27 bp, Artificial Sequence
  Description of Artificial Sequence: Synthetic oligonucleotide
ggaagagaaggctgggatggtgtccac

SEQ ID NO: 420579 - DNA, 28 bp, Artificial Sequence
  Description of Artificial Sequence: Synthetic oligonucleotide
gaagagaaggctgggatggtgtccacag

SEQ ID NO: 420580 - DNA, 28 bp, Artificial Sequence
  Description of Artificial Sequence: Synthetic oligonucleotide
aagagaaggctgggatggtgtccacagg

SEQ ID NO: 420581 - DNA, 27 bp, Artificial Sequence
  Description of Artificial Sequence: Synthetic oligonucleotide
agagaaggctgggatggtgtccacagg

SEQ ID NO: 420582 - DNA, 26 bp, Artificial Sequence
  Description of Artificial Sequence: Synthetic oligonucleotide
gagaaggctgggatggtgtccacagg

SEQ ID NO: 420583 - DNA, 26 bp, Artificial Sequence
  Description of Artificial Sequence: Synthetic oligonucleotide
agaaggctgggatggtgtccacaggc

SEQ ID NO: 420584 - DNA, 25 bp, Artificial Sequence
  Description of Artificial Sequence: Synthetic oligonucleotide
gaaggctgggatggtgtccacaggc

SEQ ID NO: 420585 - DNA, 26 bp, Artificial Sequence
  Description of Artificial Sequence: Synthetic oligonucleotide
aaggctgggatggtgtccacaggcct

SEQ ID NO: 420586 - DNA, 25 bp, Artificial Sequence
  Description of Artificial Sequence: Synthetic oligonucleotide
aggctgggatggtgtccacaggcct

SEQ ID NO: 420587 - DNA, 24 bp, Artificial Sequence
  Description of Artificial Sequence: Synthetic oligonucleotide
ggctgggatggtgtccacaggcct

SEQ ID NO: 420588 - DNA, 26 bp, Artificial Sequence
  Description of Artificial Sequence: Synthetic oligonucleotide
gctgggatggtgtccacaggcctgat

SEQ ID NO: 420589 - DNA, 26 bp, Artificial Sequence
  Description of Artificial Sequence: Synthetic oligonucleotide
ctgggatggtgtccacaggcctgatc

SEQ ID NO: 420590 - DNA, 27 bp, Artificial Sequence
  Description of Artificial Sequence: Synthetic oligonucleotide
tgggatggtgtccacaggcctgatcca

SEQ ID NO: 420591 - DNA, 26 bp, Artificial Sequence
  Description of Artificial Sequence: Synthetic oligonucleotide
gggatggtgtccacaggcctgatcca

SEQ ID NO: 420592 - DNA, 27 bp, Artificial Sequence
  Description of Artificial Sequence: Synthetic oligonucleotide
ggatggtgtccacaggcctgatccaga

SEQ ID NO: 420593 - DNA, 29 bp, Artificial Sequence
  Description of Artificial Sequence: Synthetic oligonucleotide
gatggtgtccacaggcctgatccagaatg

SEQ ID NO: 420594 - DNA, 29 bp, Artificial Sequence
  Description of Artificial Sequence: Synthetic oligonucleotide
atggtgtccacaggcctgatccagaatgg

SEQ ID NO: 420595 - DNA, 30 bp, Artificial Sequence; identical to SEQ ID NO: 72551
  Description of Artificial Sequence: Synthetic oligonucleotide

SEQ ID NO: 420596 - DNA, 31 bp, Artificial Sequence; identical to SEQ ID NO: 72552
  Description of Artificial Sequence: Synthetic oligonucleotide

SEQ ID NO: 420597 - DNA, 31 bp, Artificial Sequence; identical to SEQ ID NO: 72553
  Description of Artificial Sequence: Synthetic oligonucleotide

SEQ ID NO: 420598 - DNA, 30 bp, Artificial Sequence; identical to SEQ ID NO: 72554
  Description of Artificial Sequence: Synthetic oligonucleotide

SEQ ID NO: 420599 - DNA, 31 bp, Artificial Sequence; identical to SEQ ID NO: 72555
  Description of Artificial Sequence: Synthetic oligonucleotide

SEQ ID NO: 420600 - DNA, 32 bp, Artificial Sequence; identical to SEQ ID NO: 72556
  Description of Artificial Sequence: Synthetic oligonucleotide

SEQ ID NO: 420601 - DNA, 31 bp, Artificial Sequence; identical to SEQ ID NO: 72557
  Description of Artificial Sequence: Synthetic oligonucleotide

SEQ ID NO: 420602 - DNA, 31 bp, Artificial Sequence; identical to SEQ ID NO: 72558
  Description of Artificial Sequence: Synthetic oligonucleotide

SEQ ID NO: 420603 - DNA, 30 bp, Artificial Sequence; identical to SEQ ID NO: 72559
  Description of Artificial Sequence: Synthetic oligonucleotide

SEQ ID NO: 420604 - DNA, 29 bp, Artificial Sequence
  Description of Artificial Sequence: Synthetic oligonucleotide
gctggaaacagttcctcgaagtggagagg

SEQ ID NO: 420605 - DNA, 33 bp, Artificial Sequence; identical to SEQ ID NO: 72561
  Description of Artificial Sequence: Synthetic oligonucleotide

SEQ ID NO: 420606 - DNA, 34 bp, Artificial Sequence; identical to SEQ ID NO: 72562
  Description of Artificial Sequence: Synthetic oligonucleotide

SEQ ID NO: 420607 - DNA, 33 bp, Artificial Sequence; identical to SEQ ID NO: 72563
  Description of Artificial Sequence: Synthetic oligonucleotide

SEQ ID NO: 420608 - DNA, 33 bp, Artificial Sequence; identical to SEQ ID NO: 72564
  Description of Artificial Sequence: Synthetic oligonucleotide

SEQ ID NO: 420609 - DNA, 34 bp, Artificial Sequence; identical to SEQ ID NO: 72565
  Description of Artificial Sequence: Synthetic oligonucleotide

SEQ ID NO: 420610 - DNA, 33 bp, Artificial Sequence; identical to SEQ ID NO: 72566
  Description of Artificial Sequence: Synthetic oligonucleotide

SEQ ID NO: 420611 - DNA, 32 bp, Artificial Sequence; identical to SEQ ID NO: 72567
  Description of Artificial Sequence: Synthetic oligonucleotide

SEQ ID NO: 420612 - DNA, 31 bp, Artificial Sequence; identical to SEQ ID NO: 72568
  Description of Artificial Sequence: Synthetic oligonucleotide

SEQ ID NO: 420613 - DNA, 31 bp, Artificial Sequence; identical to SEQ ID NO: 72569
  Description of Artificial Sequence: Synthetic oligonucleotide

SEQ ID NO: 420614 - DNA, 30 bp, Artificial Sequence; identical to SEQ ID NO: 72570
  Description of Artificial Sequence: Synthetic oligonucleotide

SEQ ID NO: 420615 - DNA, 30 bp, Artificial Sequence; identical to SEQ ID NO: 72571
  Description of Artificial Sequence: Synthetic oligonucleotide

SEQ ID NO: 420616 - DNA, 29 bp, Artificial Sequence
  Description of Artificial Sequence: Synthetic oligonucleotide
tcctcgaagtggagaggtttacacctgcc

SEQ ID NO: 420617 - DNA, 28 bp, Artificial Sequence
  Description of Artificial Sequence: Synthetic oligonucleotide
cctcgaagtggagaggtttacacctgcc

SEQ ID NO: 420618 - DNA, 30 bp, Artificial Sequence; identical to SEQ ID NO: 72574
  Description of Artificial Sequence: Synthetic oligonucleotide

SEQ ID NO: 420619 - DNA, 31 bp, Artificial Sequence; identical to SEQ ID NO: 72575
  Description of Artificial Sequence: Synthetic oligonucleotide

SEQ ID NO: 420620 - DNA, 30 bp, Artificial Sequence; identical to SEQ ID NO: 72576
  Description of Artificial Sequence: Synthetic oligonucleotide

SEQ ID NO: 420621 - DNA, 30 bp, Artificial Sequence; identical to SEQ ID NO: 72577
  Description of Artificial Sequence: Synthetic oligonucleotide

SEQ ID NO: 420622 - DNA, 31 bp, Artificial Sequence; identical to SEQ ID NO: 72578
  Description of Artificial Sequence: Synthetic oligonucleotide

SEQ ID NO: 420623 - DNA, 30 bp, Artificial Sequence; identical to SEQ ID NO: 72579
  Description of Artificial Sequence: Synthetic oligonucleotide

SEQ ID NO: 420624 - DNA, 29 bp, Artificial Sequence
  Description of Artificial Sequence: Synthetic oligonucleotide
ggacacctactgcagacacaactacggag

SEQ ID NO: 420625 - DNA, 31 bp, Artificial Sequence; identical to SEQ ID NO: 72581
  Description of Artificial Sequence: Synthetic oligonucleotide

SEQ ID NO: 420626 - DNA, 32 bp, Artificial Sequence; identical to SEQ ID NO: 72582
  Description of Artificial Sequence: Synthetic oligonucleotide

SEQ ID NO: 420627 - DNA, 31 bp, Artificial Sequence; identical to SEQ ID NO: 72583
  Description of Artificial Sequence: Synthetic oligonucleotide

SEQ ID NO: 420628 - DNA, 31 bp, Artificial Sequence; identical to SEQ ID NO: 72584
  Description of Artificial Sequence: Synthetic oligonucleotide

SEQ ID NO: 420629 - DNA, 30 bp, Artificial Sequence; identical to SEQ ID NO: 72585
  Description of Artificial Sequence: Synthetic oligonucleotide

SEQ ID NO: 420630 - DNA, 31 bp, Artificial Sequence; identical to SEQ ID NO: 72586
  Description of Artificial Sequence: Synthetic oligonucleotide

SEQ ID NO: 420631 - DNA, 32 bp, Artificial Sequence; identical to SEQ ID NO: 72587
  Description of Artificial Sequence: Synthetic oligonucleotide

SEQ ID NO: 420632 - DNA, 31 bp, Artificial Sequence; identical to SEQ ID NO: 72588
  Description of Artificial Sequence: Synthetic oligonucleotide

SEQ ID NO: 420633 - DNA, 30 bp, Artificial Sequence; identical to SEQ ID NO: 72589
  Description of Artificial Sequence: Synthetic oligonucleotide

SEQ ID NO: 420634 - DNA, 30 bp, Artificial Sequence; identical to SEQ ID NO: 72590
  Description of Artificial Sequence: Synthetic oligonucleotide

SEQ ID NO: 420635 - DNA, 29 bp, Artificial Sequence
  Description of Artificial Sequence: Synthetic oligonucleotide
gcagacacaactacggagttgtggagagc

SEQ ID NO: 420636 - DNA, 31 bp, Artificial Sequence; identical to SEQ ID NO: 72592
  Description of Artificial Sequence: Synthetic oligonucleotide

SEQ ID NO: 420637 - DNA, 32 bp, Artificial Sequence; identical to SEQ ID NO: 72593
  Description of Artificial Sequence: Synthetic oligonucleotide

SEQ ID NO: 420638 - DNA, 31 bp, Artificial Sequence; identical to SEQ ID NO: 72594
  Description of Artificial Sequence: Synthetic oligonucleotide

SEQ ID NO: 420639 - DNA, 32 bp, Artificial Sequence; identical to SEQ ID NO: 72595
  Description of Artificial Sequence: Synthetic oligonucleotide

SEQ ID NO: 420640 - DNA, 31 bp, Artificial Sequence; identical to SEQ ID NO: 72596
  Description of Artificial Sequence: Synthetic oligonucleotide

SEQ ID NO: 420641 - DNA, 32 bp, Artificial Sequence; identical to SEQ ID NO: 72597
  Description of Artificial Sequence: Synthetic oligonucleotide

SEQ ID NO: 420642 - DNA, 31 bp, Artificial Sequence; identical to SEQ ID NO: 72598
  Description of Artificial Sequence: Synthetic oligonucleotide

SEQ ID NO: 420643 - DNA, 31 bp, Artificial Sequence; identical to SEQ ID NO: 72599
  Description of Artificial Sequence: Synthetic oligonucleotide

SEQ ID NO: 420644 - DNA, 30 bp, Artificial Sequence; identical to SEQ ID NO: 72600
  Description of Artificial Sequence: Synthetic oligonucleotide

SEQ ID NO: 420645 - DNA, 29 bp, Artificial Sequence
  Description of Artificial Sequence: Synthetic oligonucleotide
ctacggagttgtggagagcttcacagtgc

SEQ ID NO: 420646 - DNA, 30 bp, Artificial Sequence; identical to SEQ ID NO: 72602
  Description of Artificial Sequence: Synthetic oligonucleotide

SEQ ID NO: 420647 - DNA, 29 bp, Artificial Sequence
  Description of Artificial Sequence: Synthetic oligonucleotide
acggagttgtggagagcttcacagtgcag

SEQ ID NO: 420648 - DNA, 28 bp, Artificial Sequence
  Description of Artificial Sequence: Synthetic oligonucleotide
cggagttgtggagagcttcacagtgcag

SEQ ID NO: 420649 - DNA, 28 bp, Artificial Sequence
  Description of Artificial Sequence: Synthetic oligonucleotide
ggagttgtggagagcttcacagtgcagc

SEQ ID NO: 420650 - DNA, 28 bp, Artificial Sequence
  Description of Artificial Sequence: Synthetic oligonucleotide
gagttgtggagagcttcacagtgcagcg

SEQ ID NO: 420651 - DNA, 28 bp, Artificial Sequence
  Description of Artificial Sequence: Synthetic oligonucleotide
agttgtggagagcttcacagtgcagcgg

SEQ ID NO: 420652 - DNA, 33 bp, Artificial Sequence; identical to SEQ ID NO: 72608
  Description of Artificial Sequence: Synthetic oligonucleotide

SEQ ID NO: 420653 - DNA, 33 bp, Artificial Sequence; identical to SEQ ID NO: 72609
  Description of Artificial Sequence: Synthetic oligonucleotide

SEQ ID NO: 420654 - DNA, 34 bp, Artificial Sequence; identical to SEQ ID NO: 72610
  Description of Artificial Sequence: Synthetic oligonucleotide

SEQ ID NO: 420655 - DNA, 33 bp, Artificial Sequence; identical to SEQ ID NO: 72611
  Description of Artificial Sequence: Synthetic oligonucleotide

SEQ ID NO: 420656 - DNA, 32 bp, Artificial Sequence; identical to SEQ ID NO: 72612
  Description of Artificial Sequence: Synthetic oligonucleotide

SEQ ID NO: 420657 - DNA, 31 bp, Artificial Sequence; identical to SEQ ID NO: 72613
  Description of Artificial Sequence: Synthetic oligonucleotide

SEQ ID NO: 420658 - DNA, 31 bp, Artificial Sequence; identical to SEQ ID NO: 72614
  Description of Artificial Sequence: Synthetic oligonucleotide

SEQ ID NO: 420659 - DNA, 30 bp, Artificial Sequence; identical to SEQ ID NO: 72615
  Description of Artificial Sequence: Synthetic oligonucleotide

SEQ ID NO: 420660 - DNA, 30 bp, Artificial Sequence; identical to SEQ ID NO: 72616
  Description of Artificial Sequence: Synthetic oligonucleotide

SEQ ID NO: 420661 - DNA, 30 bp, Artificial Sequence; identical to SEQ ID NO: 72617
  Description of Artificial Sequence: Synthetic oligonucleotide

SEQ ID NO: 420662 - DNA, 30 bp, Artificial Sequence; identical to SEQ ID NO: 72618
  Description of Artificial Sequence: Synthetic oligonucleotide

SEQ ID NO: 420663 - DNA, 29 bp, Artificial Sequence
  Description of Artificial Sequence: Synthetic oligonucleotide
gtgtcatttcttcaatgggaccgagcggg

SEQ ID NO: 420664 - DNA, 30 bp, Artificial Sequence; identical to SEQ ID NO: 72620
  Description of Artificial Sequence: Synthetic oligonucleotide

SEQ ID NO: 420665 - DNA, 29 bp, Artificial Sequence
  Description of Artificial Sequence: Synthetic oligonucleotide
gtcatttcttcaatgggaccgagcgggtg

SEQ ID NO: 420666 - DNA, 29 bp, Artificial Sequence
  Description of Artificial Sequence: Synthetic oligonucleotide
tcatttcttcaatgggaccgagcgggtgc

SEQ ID NO: 420667 - DNA, 28 bp, Artificial Sequence
  Description of Artificial Sequence: Synthetic oligonucleotide
catttcttcaatgggaccgagcgggtgc

SEQ ID NO: 420668 - DNA, 28 bp, Artificial Sequence
  Description of Artificial Sequence: Synthetic oligonucleotide
atttcttcaatgggaccgagcgggtgcg

SEQ ID NO: 420669 - DNA, 27 bp, Artificial Sequence
  Description of Artificial Sequence: Synthetic oligonucleotide
tttcttcaatgggaccgagcgggtgcg

SEQ ID NO: 420670 - DNA, 26 bp, Artificial Sequence
  Description of Artificial Sequence: Synthetic oligonucleotide
ttcttcaatgggaccgagcgggtgcg

SEQ ID NO: 420671 - DNA, 25 bp, Artificial Sequence
  Description of Artificial Sequence: Synthetic oligonucleotide
tcttcaatgggaccgagcgggtgcg

SEQ ID NO: 420672 - DNA, 24 bp, Artificial Sequence
  Description of Artificial Sequence: Synthetic oligonucleotide
cttcaatgggaccgagcgggtgcg

SEQ ID NO: 420673 - DNA, 26 bp, Artificial Sequence
  Description of Artificial Sequence: Synthetic oligonucleotide
ttcaatgggaccgagcgggtgcggtt

SEQ ID NO: 420674 - DNA, 25 bp, Artificial Sequence
  Description of Artificial Sequence: Synthetic oligonucleotide
tcaatgggaccgagcgggtgcggtt

SEQ ID NO: 420675 - DNA, 24 bp, Artificial Sequence
  Description of Artificial Sequence: Synthetic oligonucleotide
caatgggaccgagcgggtgcggtt

SEQ ID NO: 420676 - DNA, 24 bp, Artificial Sequence
  Description of Artificial Sequence: Synthetic oligonucleotide
aatgggaccgagcgggtgcggttc

SEQ ID NO: 420677 - DNA, 23 bp, Artificial Sequence
  Description of Artificial Sequence: Synthetic oligonucleotide
atgggaccgagcgggtgcggttc

SEQ ID NO: 420678 - DNA, 22 bp, Artificial Sequence
  Description of Artificial Sequence: Synthetic oligonucleotide
tgggaccgagcgggtgcggttc

SEQ ID NO: 420679 - DNA, 21 bp, Artificial Sequence
  Description of Artificial Sequence: Synthetic oligonucleotide
gggaccgagcgggtgcggttc

SEQ ID NO: 420680 - DNA, 22 bp, Artificial Sequence
  Description of Artificial Sequence: Synthetic oligonucleotide
ggaccgagcgggtgcggttcct

SEQ ID NO: 420681 - DNA, 22 bp, Artificial Sequence
  Description of Artificial Sequence: Synthetic oligonucleotide
gaccgagcgggtgcggttcctg

SEQ ID NO: 420682 - DNA, 23 bp, Artificial Sequence
  Description of Artificial Sequence: Synthetic oligonucleotide
accgagcgggtgcggttcctgga

SEQ ID NO: 420683 - DNA, 22 bp, Artificial Sequence
  Description of Artificial Sequence: Synthetic oligonucleotide
ccgagcgggtgcggttcctgga

SEQ ID NO: 420684 - DNA, 23 bp, Artificial Sequence
  Description of Artificial Sequence: Synthetic oligonucleotide
cgagcgggtgcggttcctggaca

SEQ ID NO: 420685 - DNA, 25 bp, Artificial Sequence
  Description of Artificial Sequence: Synthetic oligonucleotide
agctggggcggcctgacgctgaata

SEQ ID NO: 420686 - DNA, 24 bp, Artificial Sequence
  Description of Artificial Sequence: Synthetic oligonucleotide
gctggggcggcctgacgctgaata

SEQ ID NO: 420687 - DNA, 25 bp, Artificial Sequence
  Description of Artificial Sequence: Synthetic oligonucleotide
ctggggcggcctgacgctgaatact

SEQ ID NO: 420688 - DNA, 25 bp, Artificial Sequence
  Description of Artificial Sequence: Synthetic oligonucleotide
tggggcggcctgacgctgaatactg

SEQ ID NO: 420689 - DNA, 24 bp, Artificial Sequence
  Description of Artificial Sequence: Synthetic oligonucleotide
ggggcggcctgacgctgaatactg

SEQ ID NO: 420690 - DNA, 26 bp, Artificial Sequence
  Description of Artificial Sequence: Synthetic oligonucleotide
gggcggcctgacgctgaatactggaa

SEQ ID NO: 420691 - DNA, 27 bp, Artificial Sequence
  Description of Artificial Sequence: Synthetic oligonucleotide
ggcggcctgacgctgaatactggaaca

SEQ ID NO: 420692 - DNA, 27 bp, Artificial Sequence
  Description of Artificial Sequence: Synthetic oligonucleotide
gcggcctgacgctgaatactggaacag

SEQ ID NO: 420693 - DNA, 27 bp, Artificial Sequence
  Description of Artificial Sequence: Synthetic oligonucleotide
cggcctgacgctgaatactggaacagc

SEQ ID NO: 420694 - DNA, 27 bp, Artificial Sequence
  Description of Artificial Sequence: Synthetic oligonucleotide
ggcctgacgctgaatactggaacagcc

SEQ ID NO: 420695 - DNA, 28 bp, Artificial Sequence
  Description of Artificial Sequence: Synthetic oligonucleotide
gcctgacgctgaatactggaacagccag

SEQ ID NO: 420696 - DNA, 30 bp, Artificial Sequence; identical to SEQ ID NO: 72652
  Description of Artificial Sequence: Synthetic oligonucleotide

SEQ ID NO: 420697 - DNA, 30 bp, Artificial Sequence; identical to SEQ ID NO: 72653
  Description of Artificial Sequence: Synthetic oligonucleotide

SEQ ID NO: 420698 - DNA, 31 bp, Artificial Sequence; identical to SEQ ID NO: 72654
  Description of Artificial Sequence: Synthetic oligonucleotide

SEQ ID NO: 420699 - DNA, 30 bp, Artificial Sequence; identical to SEQ ID NO: 72655
  Description of Artificial Sequence: Synthetic oligonucleotide

SEQ ID NO: 420700 - DNA, 32 bp, Artificial Sequence; identical to SEQ ID NO: 72656
  Description of Artificial Sequence: Synthetic oligonucleotide

SEQ ID NO: 420701 - DNA, 31 bp, Artificial Sequence; identical to SEQ ID NO: 72657
  Description of Artificial Sequence: Synthetic oligonucleotide

SEQ ID NO: 420702 - DNA, 31 bp, Artificial Sequence; identical to SEQ ID NO: 72658
  Description of Artificial Sequence: Synthetic oligonucleotide

SEQ ID NO: 420703 - DNA, 32 bp, Artificial Sequence; identical to SEQ ID NO: 72659
  Description of Artificial Sequence: Synthetic oligonucleotide

SEQ ID NO: 420704 - DNA, 32 bp, Artificial Sequence; identical to SEQ ID NO: 72660
  Description of Artificial Sequence: Synthetic oligonucleotide

SEQ ID NO: 420705 - DNA, 31 bp, Artificial Sequence; identical to SEQ ID NO: 72661
  Description of Artificial Sequence: Synthetic oligonucleotide

SEQ ID NO: 420706 - DNA, 32 bp, Artificial Sequence; identical to SEQ ID NO: 72662
  Description of Artificial Sequence: Synthetic oligonucleotide

SEQ ID NO: 420707 - DNA, 31 bp, Artificial Sequence; identical to SEQ ID NO: 72663
  Description of Artificial Sequence: Synthetic oligonucleotide

SEQ ID NO: 420708 - DNA, 23 bp, Artificial Sequence
  Description of Artificial Sequence: Synthetic oligonucleotide
acatcctggagcaggcgcgggct

SEQ ID NO: 420709 - DNA, 22 bp, Artificial Sequence
  Description of Artificial Sequence: Synthetic oligonucleotide
catcctggagcaggcgcgggct

SEQ ID NO: 420710 - DNA, 22 bp, Artificial Sequence
  Description of Artificial Sequence: Synthetic oligonucleotide
atcctggagcaggcgcgggctg

SEQ ID NO: 420711 - DNA, 21 bp, Artificial Sequence
  Description of Artificial Sequence: Synthetic oligonucleotide
tcctggagcaggcgcgggctg

SEQ ID NO: 420712 - DNA, 20 bp, Artificial Sequence
  Description of Artificial Sequence: Synthetic oligonucleotide
cctggagcaggcgcgggctg

SEQ ID NO: 420713 - DNA, 20 bp, Artificial Sequence
  Description of Artificial Sequence: Synthetic oligonucleotide
ctggagcaggcgcgggctgc

SEQ ID NO: 420714 - DNA, 20 bp, Artificial Sequence
  Description of Artificial Sequence: Synthetic oligonucleotide
tggagcaggcgcgggctgcg

SEQ ID NO: 420715 - DNA, 20 bp, Artificial Sequence
  Description of Artificial Sequence: Synthetic oligonucleotide
ggagcaggcgcgggctgcgt

SEQ ID NO: 420716 - DNA, 20 bp, Artificial Sequence
  Description of Artificial Sequence: Synthetic oligonucleotide
gagcaggcgcgggctgcggt

SEQ ID NO: 420717 - DNA, 20 bp, Artificial Sequence
  Description of Artificial Sequence: Synthetic oligonucleotide
agcaggcgcgggctgcggtg

SEQ ID NO: 420718 - DNA, 20 bp, Artificial Sequence
  Description of Artificial Sequence: Synthetic oligonucleotide
gcaggcgcgggctgcggtgt

SEQ ID NO: 420719 - DNA, 20 bp, Artificial Sequence
  Description of Artificial Sequence: Synthetic oligonucleotide
caggcgcgggctgcggtgga

SEQ ID NO: 420720 - DNA, 21 bp, Artificial Sequence
  Description of Artificial Sequence: Synthetic oligonucleotide
aggcgcgggctgcggtggaca

SEQ ID NO: 420721 - DNA, 20 bp, Artificial Sequence
  Description of Artificial Sequence: Synthetic oligonucleotide
ggcgcgggctgcggtggaca

SEQ ID NO: 420722 - DNA, 20 bp, Artificial Sequence
  Description of Artificial Sequence: Synthetic oligonucleotide
gcgcgggctgcggtggacac

SEQ ID NO: 420723 - DNA, 22 bp, Artificial Sequence
  Description of Artificial Sequence: Synthetic oligonucleotide
cgcgggctgcggtggacaccta

SEQ ID NO: 420724 - DNA, 25 bp, Artificial Sequence
  Description of Artificial Sequence: Synthetic oligonucleotide
gcttcgacagcgacgtcggggagtt

SEQ ID NO: 420725 - DNA, 25 bp, Artificial Sequence
  Description of Artificial Sequence: Synthetic oligonucleotide
cttcgacagcgacgtcggggagttc

SEQ ID NO: 420726 - DNA, 25 bp, Artificial Sequence
  Description of Artificial Sequence: Synthetic oligonucleotide
ttcgacagcgacgtcggggagttcc

SEQ ID NO: 420727 - DNA, 24 bp, Artificial Sequence
  Description of Artificial Sequence: Synthetic oligonucleotide
tcgacagcgacgtcggggagttcc

SEQ ID NO: 420728 - DNA, 23 bp, Artificial Sequence
  Description of Artificial Sequence: Synthetic oligonucleotide
cgacagcgacgtcggggagttcc

SEQ ID NO: 420729 - DNA, 23 bp, Artificial Sequence
  Description of Artificial Sequence: Synthetic oligonucleotide
gacagcgacgtcggggagttccg

SEQ ID NO: 420730 - DNA, 23 bp, Artificial Sequence
  Description of Artificial Sequence: Synthetic oligonucleotide
acagcgacgtcggggagttccgg

SEQ ID NO: 420731 - DNA, 22 bp, Artificial Sequence
  Description of Artificial Sequence: Synthetic oligonucleotide
cagcgacgtcggggagttccgg

SEQ ID NO: 420732 - DNA, 22 bp, Artificial Sequence
  Description of Artificial Sequence: Synthetic oligonucleotide
agcgacgtcggggagttccggg

SEQ ID NO: 420733 - DNA, 21 bp, Artificial Sequence
  Description of Artificial Sequence: Synthetic oligonucleotide
gcgacgtcggggagttccggg

SEQ ID NO: 420734 - DNA, 21 bp, Artificial Sequence
  Description of Artificial Sequence: Synthetic oligonucleotide
cgacgtcggggagttccgggc

SEQ ID NO: 420735 - DNA, 21 bp, Artificial Sequence
  Description of Artificial Sequence: Synthetic oligonucleotide
gacgtcggggagttccgggcg

SEQ ID NO: 420736 - DNA, 22 bp, Artificial Sequence
  Description of Artificial Sequence: Synthetic oligonucleotide
acgtcggggagttccgggcggt

SEQ ID NO: 420737 - DNA, 21 bp, Artificial Sequence
  Description of Artificial Sequence: Synthetic oligonucleotide
cgtcggggagttccgggcggt

SEQ ID NO: 420738 - DNA, 22 bp, Artificial Sequence
  Description of Artificial Sequence: Synthetic oligonucleotide
gtcggggagttccgggcggtga

SEQ ID NO: 420739 - DNA, 22 bp, Artificial Sequence
  Description of Artificial Sequence: Synthetic oligonucleotide
tcggggagttccgggcggtgac

SEQ ID NO: 420740 - DNA, 21 bp, Artificial Sequence
  Description of Artificial Sequence: Synthetic oligonucleotide
cggggagttccgggcggtgac

SEQ ID NO: 420741 - DNA, 26 bp, Artificial Sequence
  Description of Artificial Sequence: Synthetic oligonucleotide
cgcttcgacagcgatgtgggggagtt

SEQ ID NO: 420742 - DNA, 26 bp, Artificial Sequence
  Description of Artificial Sequence: Synthetic oligonucleotide
gcttcgacagcgatgtgggggagttc

SEQ ID NO: 420743 - DNA, 26 bp, Artificial Sequence
  Description of Artificial Sequence: Synthetic oligonucleotide
cttcgacagcgatgtgggggagttcc

SEQ ID NO: 420744 - DNA, 26 bp, Artificial Sequence
  Description of Artificial Sequence: Synthetic oligonucleotide
ttcgacagcgatgtgggggagttccg

SEQ ID NO: 420745 - DNA, 25 bp, Artificial Sequence
  Description of Artificial Sequence: Synthetic oligonucleotide
tcgacagcgatgtgggggagttccg

SEQ ID NO: 420746 - DNA, 24 bp, Artificial Sequence
  Description of Artificial Sequence: Synthetic oligonucleotide
cgacagcgatgtgggggagttccg

SEQ ID NO: 420747 - DNA, 24 bp, Artificial Sequence
  Description of Artificial Sequence: Synthetic oligonucleotide
gacagcgatgtgggggagttccgg

SEQ ID NO: 420748 - DNA, 24 bp, Artificial Sequence
  Description of Artificial Sequence: Synthetic oligonucleotide
acagcgatgtgggggagttccggg

SEQ ID NO: 420749 - DNA, 23 bp, Artificial Sequence
  Description of Artificial Sequence: Synthetic oligonucleotide
cagcgatgtgggggagttccggg

SEQ ID NO: 420750 - DNA, 23 bp, Artificial Sequence
  Description of Artificial Sequence: Synthetic oligonucleotide
agcgatgtgggggagttccgggc

SEQ ID NO: 420751 - DNA, 22 bp, Artificial Sequence
  Description of Artificial Sequence: Synthetic oligonucleotide
gcgatgtgggggagttccgggc

SEQ ID NO: 420752 - DNA, 22 bp, Artificial Sequence
  Description of Artificial Sequence: Synthetic oligonucleotide
cgatgtgggggagttccgggcg

SEQ ID NO: 420753 - DNA, 23 bp, Artificial Sequence
  Description of Artificial Sequence: Synthetic oligonucleotide
gatgtgggggagttccgggcggt

SEQ ID NO: 420754 - DNA, 24 bp, Artificial Sequence
  Description of Artificial Sequence: Synthetic oligonucleotide
atgtgggggagttccgggcggtga

SEQ ID NO: 420755 - DNA, 23 bp, Artificial Sequence
  Description of Artificial Sequence: Synthetic oligonucleotide
tgtgggggagttccgggcggtga

SEQ ID NO: 420756 - DNA, 32 bp, Artificial Sequence; identical to SEQ ID NO: 72715
  Description of Artificial Sequence: Synthetic oligonucleotide

SEQ ID NO: 420757 - DNA, 31 bp, Artificial Sequence; identical to SEQ ID NO: 72716
  Description of Artificial Sequence: Synthetic oligonucleotide

SEQ ID NO: 420758 - DNA, 31 bp, Artificial Sequence; identical to SEQ ID NO: 72717
  Description of Artificial Sequence: Synthetic oligonucleotide

SEQ ID NO: 420759 - DNA, 32 bp, Artificial Sequence; identical to SEQ ID NO: 72718
  Description of Artificial Sequence: Synthetic oligonucleotide

SEQ ID NO: 420760 - DNA, 32 bp, Artificial Sequence; identical to SEQ ID NO: 72719
  Description of Artificial Sequence: Synthetic oligonucleotide

SEQ ID NO: 420761 - DNA, 33 bp, Artificial Sequence; identical to SEQ ID NO: 72720
  Description of Artificial Sequence: Synthetic oligonucleotide

SEQ ID NO: 420762 - DNA, 32 bp, Artificial Sequence; identical to SEQ ID NO: 72721
  Description of Artificial Sequence: Synthetic oligonucleotide

SEQ ID NO: 420763 - DNA, 31 bp, Artificial Sequence; identical to SEQ ID NO: 72722
  Description of Artificial Sequence: Synthetic oligonucleotide

SEQ ID NO: 420764 - DNA, 32 bp, Artificial Sequence; identical to SEQ ID NO: 72723
  Description of Artificial Sequence: Synthetic oligonucleotide

SEQ ID NO: 420765 - DNA, 32 bp, Artificial Sequence; identical to SEQ ID NO: 72724
  Description of Artificial Sequence: Synthetic oligonucleotide

SEQ ID NO: 420766 - DNA, 31 bp, Artificial Sequence; identical to SEQ ID NO: 72725
  Description of Artificial Sequence: Synthetic oligonucleotide

SEQ ID NO: 420767 - DNA, 31 bp, Artificial Sequence; identical to SEQ ID NO: 72726
  Description of Artificial Sequence: Synthetic oligonucleotide

SEQ ID NO: 420768 - DNA, 32 bp, Artificial Sequence; identical to SEQ ID NO: 72727
  Description of Artificial Sequence: Synthetic oligonucleotide

SEQ ID NO: 420769 - DNA, 31 bp, Artificial Sequence; identical to SEQ ID NO: 72728
  Description of Artificial Sequence: Synthetic oligonucleotide

SEQ ID NO: 420770 - DNA, 31 bp, Artificial Sequence; identical to SEQ ID NO: 72729
  Description of Artificial Sequence: Synthetic oligonucleotide

SEQ ID NO: 420771 - DNA, 30 bp, Artificial Sequence; identical to SEQ ID NO: 72730
  Description of Artificial Sequence: Synthetic oligonucleotide

SEQ ID NO: 420772 - DNA, 30 bp, Artificial Sequence; identical to SEQ ID NO: 72731
  Description of Artificial Sequence: Synthetic oligonucleotide

SEQ ID NO: 420773 - DNA, 29 bp, Artificial Sequence
  Description of Artificial Sequence: Synthetic oligonucleotide
tacttctacaaccaggaggagtccgtgcg

SEQ ID NO: 420774 - DNA, 28 bp, Artificial Sequence
  Description of Artificial Sequence: Synthetic oligonucleotide
acttctacaaccaggaggagtccgtgcg

SEQ ID NO: 420775 - DNA, 27 bp, Artificial Sequence
  Description of Artificial Sequence: Synthetic oligonucleotide
cttctacaaccaggaggagtccgtgcg

SEQ ID NO: 420776 - DNA, 27 bp, Artificial Sequence
  Description of Artificial Sequence: Synthetic oligonucleotide
ttctacaaccaggaggagtccgtgcgc

SEQ ID NO: 420777 - DNA, 27 bp, Artificial Sequence
  Description of Artificial Sequence: Synthetic oligonucleotide
tctacaaccaggaggagtccgtgcgct

SEQ ID NO: 420778 - DNA, 27 bp, Artificial Sequence
  Description of Artificial Sequence: Synthetic oligonucleotide
ctacaaccaggaggagtccgtgcgctt

SEQ ID NO: 420779 - DNA, 27 bp, Artificial Sequence
  Description of Artificial Sequence: Synthetic oligonucleotide
tacaaccaggaggagtccgtgcgcttc

SEQ ID NO: 420780 - DNA, 26 bp, Artificial Sequence
  Description of Artificial Sequence: Synthetic oligonucleotide
acaaccaggaggagtccgtgcgcttc

SEQ ID NO: 420781 - DNA, 25 bp, Artificial Sequence
  Description of Artificial Sequence: Synthetic oligonucleotide
caaccaggaggagtccgtgcgcttc

SEQ ID NO: 420782 - DNA, 27 bp, Artificial Sequence
  Description of Artificial Sequence: Synthetic oligonucleotide
ccgcggtggacacctactgcagacata

SEQ ID NO: 420783 - DNA, 28 bp, Artificial Sequence
  Description of Artificial Sequence: Synthetic oligonucleotide
cgcggtggacacctactgcagacataac

SEQ ID NO: 420784 - DNA, 30 bp, Artificial Sequence; identical to SEQ ID NO: 72743
  Description of Artificial Sequence: Synthetic oligonucleotide

SEQ ID NO: 420785 - DNA, 30 bp, Artificial Sequence; identical to SEQ ID NO: 72744
  Description of Artificial Sequence: Synthetic oligonucleotide

SEQ ID NO: 420786 - DNA, 30 bp, Artificial Sequence; identical to SEQ ID NO: 72745
  Description of Artificial Sequence: Synthetic oligonucleotide

SEQ ID NO: 420787 - DNA, 30 bp, Artificial Sequence; identical to SEQ ID NO: 72746
  Description of Artificial Sequence: Synthetic oligonucleotide

SEQ ID NO: 420788 - DNA, 30 bp, Artificial Sequence; identical to SEQ ID NO: 72747
  Description of Artificial Sequence: Synthetic oligonucleotide

SEQ ID NO: 420789 - DNA, 29 bp, Artificial Sequence
  Description of Artificial Sequence: Synthetic oligonucleotide
ggacacctactgcagacataactacgggg

SEQ ID NO: 420790 - DNA, 31 bp, Artificial Sequence; identical to SEQ ID NO: 72749
  Description of Artificial Sequence: Synthetic oligonucleotide

SEQ ID NO: 420791 - DNA, 32 bp, Artificial Sequence; identical to SEQ ID NO: 72750
  Description of Artificial Sequence: Synthetic oligonucleotide

SEQ ID NO: 420792 - DNA, 31 bp, Artificial Sequence; identical to SEQ ID NO: 72751
  Description of Artificial Sequence: Synthetic oligonucleotide

SEQ ID NO: 420793 - DNA, 31 bp, Artificial Sequence; identical to SEQ ID NO: 72752
  Description of Artificial Sequence: Synthetic oligonucleotide

SEQ ID NO: 420794 - DNA, 30 bp, Artificial Sequence; identical to SEQ ID NO: 72753
  Description of Artificial Sequence: Synthetic oligonucleotide

SEQ ID NO: 420795 - DNA, 31 bp, Artificial Sequence; identical to SEQ ID NO: 72754
  Description of Artificial Sequence: Synthetic oligonucleotide

SEQ ID NO: 420796 - DNA, 32 bp, Artificial Sequence; identical to SEQ ID NO: 72755
  Description of Artificial Sequence: Synthetic oligonucleotide

SEQ ID NO: 420797 - DNA, 31 bp, Artificial Sequence; identical to SEQ ID NO: 72756
  Description of Artificial Sequence: Synthetic oligonucleotide

SEQ ID NO: 420798 - DNA, 30 bp, Artificial Sequence; identical to SEQ ID NO: 72757
  Description of Artificial Sequence: Synthetic oligonucleotide

SEQ ID NO: 420799 - DNA, 30 bp, Artificial Sequence; identical to SEQ ID NO: 72758
  Description of Artificial Sequence: Synthetic oligonucleotide

SEQ ID NO: 420800 - DNA, 29 bp, Artificial Sequence
  Description of Artificial Sequence: Synthetic oligonucleotide
gcagacataactacggggttgtggagagc

SEQ ID NO: 420801 - DNA, 31 bp, Artificial Sequence; identical to SEQ ID NO: 72760
  Description of Artificial Sequence: Synthetic oligonucleotide

SEQ ID NO: 420802 - DNA, 32 bp, Artificial Sequence; identical to SEQ ID NO: 72761
  Description of Artificial Sequence: Synthetic oligonucleotide

SEQ ID NO: 420803 - DNA, 31 bp, Artificial Sequence; identical to SEQ ID NO: 72762
  Description of Artificial Sequence: Synthetic oligonucleotide

SEQ ID NO: 420804 - DNA, 32 bp, Artificial Sequence; identical to SEQ ID NO: 72763
  Description of Artificial Sequence: Synthetic oligonucleotide

SEQ ID NO: 420805 - DNA, 31 bp, Artificial Sequence; identical to SEQ ID NO: 72764
  Description of Artificial Sequence: Synthetic oligonucleotide

SEQ ID NO: 420806 - DNA, 32 bp, Artificial Sequence; identical to SEQ ID NO: 72765
  Description of Artificial Sequence: Synthetic oligonucleotide

SEQ ID NO: 420807 - DNA, 31 bp, Artificial Sequence; identical to SEQ ID NO: 72766
  Description of Artificial Sequence: Synthetic oligonucleotide

SEQ ID NO: 420808 - DNA, 32 bp, Artificial Sequence
  Description of Artificial Sequence: Synthetic oligonucleotide
agggagtgtcatttcttcaatgggacggagag

SEQ ID NO: 420809 - DNA, 31 bp, Artificial Sequence
  Description of Artificial Sequence: Synthetic oligonucleotide
gggagtgtcatttcttcaatgggacggagag

SEQ ID NO: 420810 - DNA, 31 bp, Artificial Sequence
  Description of Artificial Sequence: Synthetic oligonucleotide
ggagtgtcatttcttcaatgggacggagagg

SEQ ID NO: 420811 - DNA, 31 bp, Artificial Sequence
  Description of Artificial Sequence: Synthetic oligonucleotide
gagtgtcatttcttcaatgggacggagaggg

SEQ ID NO: 420812 - DNA, 32 bp, Artificial Sequence
  Description of Artificial Sequence: Synthetic oligonucleotide
agtgtcatttcttcaatgggacggagagggtg

SEQ ID NO: 420813 - DNA, 31 bp, Artificial Sequence
  Description of Artificial Sequence: Synthetic oligonucleotide
gtgtcatttcttcaatgggacggagagggtg

SEQ ID NO: 420814 - DNA, 31 bp, Artificial Sequence
  Description of Artificial Sequence: Synthetic oligonucleotide
tgtcatttcttcaatgggacggagagggtgc

SEQ ID NO: 420815 - DNA, 30 bp, Artificial Sequence
  Description of Artificial Sequence: Synthetic oligonucleotide
gtcatttcttcaatgggacggagagggtgc

SEQ ID NO: 420816 - DNA, 30 bp, Artificial Sequence
  Description of Artificial Sequence: Synthetic oligonucleotide
tcatttcttcaatgggacggagagggtgcg

SEQ ID NO: 420817 - DNA, 29 bp, Artificial Sequence
  Description of Artificial Sequence: Synthetic oligonucleotide
catttcttcaatgggacggagagggtgcg

SEQ ID NO: 420818 - DNA, 29 bp, Artificial Sequence
  Description of Artificial Sequence: Synthetic oligonucleotide
atttcttcaatgggacggagagggtgcgg

SEQ ID NO: 420819 - DNA, 28 bp, Artificial Sequence
  Description of Artificial Sequence: Synthetic oligonucleotide
tttcttcaatgggacggagagggtgcgg

SEQ ID NO: 420820 - DNA, 27 bp, Artificial Sequence
  Description of Artificial Sequence: Synthetic oligonucleotide
ttcttcaatgggacggagagggtgcgg

SEQ ID NO: 420821 - DNA, 27 bp, Artificial Sequence
  Description of Artificial Sequence: Synthetic oligonucleotide
tcttcaatgggacggagagggtgcggt

SEQ ID NO: 420822 - DNA, 27 bp, Artificial Sequence
  Description of Artificial Sequence: Synthetic oligonucleotide
cttcaatgggacggagagggtgcggtt

SEQ ID NO: 420823 - DNA, 27 bp, Artificial Sequence
  Description of Artificial Sequence: Synthetic oligonucleotide
ttcaatgggacggagagggtgcggttc

SEQ ID NO: 420824 - DNA, 26 bp, Artificial Sequence
  Description of Artificial Sequence: Synthetic oligonucleotide
tcaatgggacggagagggtgcggttc

SEQ ID NO: 420825 - DNA, 25 bp, Artificial Sequence
  Description of Artificial Sequence: Synthetic oligonucleotide
caatgggacggagagggtgcggttc

SEQ ID NO: 420826 - DNA, 26 bp, Artificial Sequence
  Description of Artificial Sequence: Synthetic oligonucleotide
aatgggacggagagggtgcggttcct

SEQ ID NO: 420827 - DNA, 25 bp, Artificial Sequence
  Description of Artificial Sequence: Synthetic oligonucleotide
atgggacggagagggtgcggttcct

SEQ ID NO: 420828 - DNA, 24 bp, Artificial Sequence
  Description of Artificial Sequence: Synthetic oligonucleotide
tgggacggagagggtgcggttcct

SEQ ID NO: 420829 - DNA, 33 bp, Artificial Sequence
  Description of Artificial Sequence: Synthetic oligonucleotide
agggtgcggttcctggacagatacttctataac

SEQ ID NO: 420830 - DNA, 20 bp, Artificial Sequence
  Description of Artificial Sequence: Synthetic oligonucleotide
agcaggcgcgggccgcggta

SEQ ID NO: 420831 - DNA, 20 bp, Artificial Sequence
  Description of Artificial Sequence: Synthetic oligonucleotide
gcaggcgcgggccgcggtat

SEQ ID NO: 420832 - DNA, 20 bp, Artificial Sequence
  Description of Artificial Sequence: Synthetic oligonucleotide
caggcgcgggccgcggtaga

SEQ ID NO: 420833 - DNA, 21 bp, Artificial Sequence
  Description of Artificial Sequence: Synthetic oligonucleotide
aggcgcgggccgcggtagaca

SEQ ID NO: 420834 - DNA, 20 bp, Artificial Sequence
  Description of Artificial Sequence: Synthetic oligonucleotide
ggcgcgggccgcggtagaca

SEQ ID NO: 420835 - DNA, 20 bp, Artificial Sequence
  Description of Artificial Sequence: Synthetic oligonucleotide
gcgcgggccgcggtagacac

SEQ ID NO: 420836 - DNA, 22 bp, Artificial Sequence
  Description of Artificial Sequence: Synthetic oligonucleotide
cgcgggccgcggtagacaccta

SEQ ID NO: 420837 - DNA, 23 bp, Artificial Sequence
  Description of Artificial Sequence: Synthetic oligonucleotide
gcgggccgcggtagacacctact

SEQ ID NO: 420838 - DNA, 23 bp, Artificial Sequence
  Description of Artificial Sequence: Synthetic oligonucleotide
cgggccgcggtagacacctactg

SEQ ID NO: 420839 - DNA, 24 bp, Artificial Sequence
  Description of Artificial Sequence: Synthetic oligonucleotide
gggccgcggtagacacctactgca

SEQ ID NO: 420840 - DNA, 25 bp, Artificial Sequence
  Description of Artificial Sequence: Synthetic oligonucleotide
ggccgcggtagacacctactgcaga

SEQ ID NO: 420841 - DNA, 26 bp, Artificial Sequence
  Description of Artificial Sequence: Synthetic oligonucleotide
gccgcggtagacacctactgcagaca

SEQ ID NO: 420842 - DNA, 27 bp, Artificial Sequence
  Description of Artificial Sequence: Synthetic oligonucleotide
ccgcggtagacacctactgcagacaca

SEQ ID NO: 420843 - DNA, 28 bp, Artificial Sequence
  Description of Artificial Sequence: Synthetic oligonucleotide
cgcggtagacacctactgcagacacaac

SEQ ID NO: 420844 - DNA, 30 bp, Artificial Sequence
  Description of Artificial Sequence: Synthetic oligonucleotide
gcggtagacacctactgcagacacaactac

SEQ ID NO: 420845 - DNA, 30 bp, Artificial Sequence
  Description of Artificial Sequence: Synthetic oligonucleotide
cggtagacacctactgcagacacaactacg

SEQ ID NO: 420846 - DNA, 30 bp, Artificial Sequence
  Description of Artificial Sequence: Synthetic oligonucleotide
ggtagacacctactgcagacacaactacgg

SEQ ID NO: 420847 - DNA, 30 bp, Artificial Sequence
  Description of Artificial Sequence: Synthetic oligonucleotide
gtagacacctactgcagacacaactacggg

SEQ ID NO: 420848 - DNA, 30 bp, Artificial Sequence
  Description of Artificial Sequence: Synthetic oligonucleotide
tagacacctactgcagacacaactacgggg

SEQ ID NO: 420849 - DNA, 29 bp, Artificial Sequence
  Description of Artificial Sequence: Synthetic oligonucleotide
agacacctactgcagacacaactacgggg

SEQ ID NO: 420850 - DNA, 31 bp, Artificial Sequence
  Description of Artificial Sequence: Synthetic oligonucleotide
ttctataaccaggaggagtccgtgcgctttg

SEQ ID NO: 420851 - DNA, 30 bp, Artificial Sequence
  Description of Artificial Sequence: Synthetic oligonucleotide
tctataaccaggaggagtccgtgcgctttg

SEQ ID NO: 420852 - DNA, 29 bp, Artificial Sequence
  Description of Artificial Sequence: Synthetic oligonucleotide
ctataaccaggaggagtccgtgcgctttg

SEQ ID NO: 420853 - DNA, 30 bp, Artificial Sequence
  Description of Artificial Sequence: Synthetic oligonucleotide
tataaccaggaggagtccgtgcgctttgac

SEQ ID NO: 420854 - DNA, 29 bp, Artificial Sequence
  Description of Artificial Sequence: Synthetic oligonucleotide
ataaccaggaggagtccgtgcgctttgac

SEQ ID NO: 420855 - DNA, 28 bp, Artificial Sequence
  Description of Artificial Sequence: Synthetic oligonucleotide
taaccaggaggagtccgtgcgctttgac

SEQ ID NO: 420856 - DNA, 27 bp, Artificial Sequence
  Description of Artificial Sequence: Synthetic oligonucleotide
aaccaggaggagtccgtgcgctttgac

SEQ ID NO: 420857 - DNA, 27 bp, Artificial Sequence
  Description of Artificial Sequence: Synthetic oligonucleotide
accaggaggagtccgtgcgctttgaca

SEQ ID NO: 420858 - DNA, 26 bp, Artificial Sequence
  Description of Artificial Sequence: Synthetic oligonucleotide
ccaggaggagtccgtgcgctttgaca

SEQ ID NO: 420859 - DNA, 26 bp, Artificial Sequence
  Description of Artificial Sequence: Synthetic oligonucleotide
caggaggagtccgtgcgctttgacag

SEQ ID NO: 420860 - DNA, 26 bp, Artificial Sequence
  Description of Artificial Sequence: Synthetic oligonucleotide
aggaggagtccgtgcgctttgacagc

SEQ ID NO: 420861 - DNA, 25 bp, Artificial Sequence
  Description of Artificial Sequence: Synthetic oligonucleotide
ggaggagtccgtgcgctttgacagc

SEQ ID NO: 420862 - DNA, 26 bp, Artificial Sequence
  Description of Artificial Sequence: Synthetic oligonucleotide
gaggagtccgtgcgctttgacagcga

SEQ ID NO: 420863 - DNA, 26 bp, Artificial Sequence
  Description of Artificial Sequence: Synthetic oligonucleotide
aggagtccgtgcgctttgacagcgac

SEQ ID NO: 420864 - DNA, 25 bp, Artificial Sequence
  Description of Artificial Sequence: Synthetic oligonucleotide
ggagtccgtgcgctttgacagcgac

SEQ ID NO: 420865 - DNA, 26 bp, Artificial Sequence
  Description of Artificial Sequence: Synthetic oligonucleotide
gagtccgtgcgctttgacagcgacgt

SEQ ID NO: 420866 - DNA, 26 bp, Artificial Sequence
  Description of Artificial Sequence: Synthetic oligonucleotide
agtccgtgcgctttgacagcgacgtg

SEQ ID NO: 420867 - DNA, 25 bp, Artificial Sequence
  Description of Artificial Sequence: Synthetic oligonucleotide
gtccgtgcgctttgacagcgacgtg

SEQ ID NO: 420868 - DNA, 25 bp, Artificial Sequence
  Description of Artificial Sequence: Synthetic oligonucleotide
tccgtgcgctttgacagcgacgtgg

SEQ ID NO: 420869 - DNA, 24 bp, Artificial Sequence
  Description of Artificial Sequence: Synthetic oligonucleotide
ccgtgcgctttgacagcgacgtgg

SEQ ID NO: 420870 - DNA, 33 bp, Artificial Sequence
  Description of Artificial Sequence: Synthetic oligonucleotide
ctgtggcagcctaagagggagtgtcattttttc

SEQ ID NO: 420871 - DNA, 36 bp, Artificial Sequence
  Description of Artificial Sequence: Synthetic oligonucleotide
tgtggcagcctaagagggagtgtcattttttcaatg

SEQ ID NO: 420872 - DNA, 35 bp, Artificial Sequence
  Description of Artificial Sequence: Synthetic oligonucleotide
gtggcagcctaagagggagtgtcattttttcaatg

SEQ ID NO: 420873 - DNA, 35 bp, Artificial Sequence
  Description of Artificial Sequence: Synthetic oligonucleotide
tggcagcctaagagggagtgtcattttttcaatgg

SEQ ID NO: 420874 - DNA, 34 bp, Artificial Sequence
  Description of Artificial Sequence: Synthetic oligonucleotide
ggcagcctaagagggagtgtcattttttcaatgg

SEQ ID NO: 420875 - DNA, 34 bp, Artificial Sequence
  Description of Artificial Sequence: Synthetic oligonucleotide
gcagcctaagagggagtgtcattttttcaatggg

SEQ ID NO: 420876 - DNA, 35 bp, Artificial Sequence
  Description of Artificial Sequence: Synthetic oligonucleotide
cagcctaagagggagtgtcattttttcaatgggac

SEQ ID NO: 420877 - DNA, 35 bp, Artificial Sequence
  Description of Artificial Sequence: Synthetic oligonucleotide
agcctaagagggagtgtcattttttcaatgggacg

SEQ ID NO: 420878 - DNA, 34 bp, Artificial Sequence
  Description of Artificial Sequence: Synthetic oligonucleotide
gcctaagagggagtgtcattttttcaatgggacg

SEQ ID NO: 420879 - DNA, 34 bp, Artificial Sequence
  Description of Artificial Sequence: Synthetic oligonucleotide
cctaagagggagtgtcattttttcaatgggacgg

SEQ ID NO: 420880 - DNA, 35 bp, Artificial Sequence
  Description of Artificial Sequence: Synthetic oligonucleotide
ctaagagggagtgtcattttttcaatgggacggag

SEQ ID NO: 420881 - DNA, 35 bp, Artificial Sequence
  Description of Artificial Sequence: Synthetic oligonucleotide
taagagggagtgtcattttttcaatgggacggagc

SEQ ID NO: 420882 - DNA, 34 bp, Artificial Sequence
  Description of Artificial Sequence: Synthetic oligonucleotide
aagagggagtgtcattttttcaatgggacggagc

SEQ ID NO: 420883 - DNA, 33 bp, Artificial Sequence
  Description of Artificial Sequence: Synthetic oligonucleotide
agagggagtgtcattttttcaatgggacggagc

SEQ ID NO: 420884 - DNA, 32 bp, Artificial Sequence
  Description of Artificial Sequence: Synthetic oligonucleotide
gagggagtgtcattttttcaatgggacggagc

SEQ ID NO: 420885 - DNA, 32 bp, Artificial Sequence
  Description of Artificial Sequence: Synthetic oligonucleotide
agggagtgtcattttttcaatgggacggagcg

SEQ ID NO: 420886 - DNA, 31 bp, Artificial Sequence
  Description of Artificial Sequence: Synthetic oligonucleotide
gggagtgtcattttttcaatgggacggagcg

SEQ ID NO: 420887 - DNA, 31 bp, Artificial Sequence
  Description of Artificial Sequence: Synthetic oligonucleotide
ggagtgtcattttttcaatgggacggagcgg

SEQ ID NO: 420888 - DNA, 31 bp, Artificial Sequence
  Description of Artificial Sequence: Synthetic oligonucleotide
gagtgtcattttttcaatgggacggagcggg

SEQ ID NO: 420889 - DNA, 32 bp, Artificial Sequence
  Description of Artificial Sequence: Synthetic oligonucleotide
agtgtcattttttcaatgggacggagcgggtg

SEQ ID NO: 420890 - DNA, 31 bp, Artificial Sequence
  Description of Artificial Sequence: Synthetic oligonucleotide
gtgtcattttttcaatgggacggagcgggtg

SEQ ID NO: 420891 - DNA, 31 bp, Artificial Sequence
  Description of Artificial Sequence: Synthetic oligonucleotide
tgtcattttttcaatgggacggagcgggtgc

SEQ ID NO: 420892 - DNA, 30 bp, Artificial Sequence
  Description of Artificial Sequence: Synthetic oligonucleotide
gtcattttttcaatgggacggagcgggtgc

SEQ ID NO: 420893 - DNA, 30 bp, Artificial Sequence
  Description of Artificial Sequence: Synthetic oligonucleotide
tcattttttcaatgggacggagcgggtgcg

SEQ ID NO: 420894 - DNA, 29 bp, Artificial Sequence
  Description of Artificial Sequence: Synthetic oligonucleotide
cattttttcaatgggacggagcgggtgcg

SEQ ID NO: 420895 - DNA, 29 bp, Artificial Sequence
  Description of Artificial Sequence: Synthetic oligonucleotide
attttttcaatgggacggagcgggtgcgg

SEQ ID NO: 420896 - DNA, 28 bp, Artificial Sequence
  Description of Artificial Sequence: Synthetic oligonucleotide
ttttttcaatgggacggagcgggtgcgg

SEQ ID NO: 420897 - DNA, 27 bp, Artificial Sequence
  Description of Artificial Sequence: Synthetic oligonucleotide
tttttcaatgggacggagcgggtgcgg

SEQ ID NO: 420898 - DNA, 27 bp, Artificial Sequence
  Description of Artificial Sequence: Synthetic oligonucleotide
ttttcaatgggacggagcgggtgcggt

SEQ ID NO: 420899 - DNA, 27 bp, Artificial Sequence
  Description of Artificial Sequence: Synthetic oligonucleotide
tttcaatgggacggagcgggtgcggtt

SEQ ID NO: 420900 - DNA, 26 bp, Artificial Sequence
  Description of Artificial Sequence: Synthetic oligonucleotide
tgccaagtggagcacccaagcgtgac

SEQ ID NO: 420901 - DNA, 25 bp, Artificial Sequence
  Description of Artificial Sequence: Synthetic oligonucleotide
gccaagtggagcacccaagcgtgac

SEQ ID NO: 420902 - DNA, 26 bp, Artificial Sequence
  Description of Artificial Sequence: Synthetic oligonucleotide
ccaagtggagcacccaagcgtgacga

SEQ ID NO: 420903 - DNA, 26 bp, Artificial Sequence
  Description of Artificial Sequence: Synthetic oligonucleotide
caagtggagcacccaagcgtgacgag

SEQ ID NO: 420904 - DNA, 26 bp, Artificial Sequence
  Description of Artificial Sequence: Synthetic oligonucleotide
aagtggagcacccaagcgtgacgagc

SEQ ID NO: 420905 - DNA, 25 bp, Artificial Sequence
  Description of Artificial Sequence: Synthetic oligonucleotide
agtggagcacccaagcgtgacgagc

SEQ ID NO: 420906 - DNA, 24 bp, Artificial Sequence
  Description of Artificial Sequence: Synthetic oligonucleotide
gtggagcacccaagcgtgacgagc

SEQ ID NO: 420907 - DNA, 24 bp, Artificial Sequence
  Description of Artificial Sequence: Synthetic oligonucleotide
tggagcacccaagcgtgacgagcc

SEQ ID NO: 420908 - DNA, 23 bp, Artificial Sequence
  Description of Artificial Sequence: Synthetic oligonucleotide
ggagcacccaagcgtgacgagcc

SEQ ID NO: 420909 - DNA, 24 bp, Artificial Sequence
  Description of Artificial Sequence: Synthetic oligonucleotide
gagcacccaagcgtgacgagccct

SEQ ID NO: 420910 - DNA, 25 bp, Artificial Sequence
  Description of Artificial Sequence: Synthetic oligonucleotide
agcacccaagcgtgacgagccctct

SEQ ID NO: 420911 - DNA, 24 bp, Artificial Sequence
  Description of Artificial Sequence: Synthetic oligonucleotide
gcacccaagcgtgacgagccctct

SEQ ID NO: 420912 - DNA, 25 bp, Artificial Sequence
  Description of Artificial Sequence: Synthetic oligonucleotide
cacccaagcgtgacgagccctctca

SEQ ID NO: 420913 - DNA, 26 bp, Artificial Sequence
  Description of Artificial Sequence: Synthetic oligonucleotide
acccaagcgtgacgagccctctcaca

SEQ ID NO: 420914 - DNA, 25 bp, Artificial Sequence
  Description of Artificial Sequence: Synthetic oligonucleotide
cccaagcgtgacgagccctctcaca

SEQ ID NO: 420915 - DNA, 26 bp, Artificial Sequence
  Description of Artificial Sequence: Synthetic oligonucleotide
ccaagcgtgacgagccctctcacagt

SEQ ID NO: 420916 - DNA, 26 bp, Artificial Sequence
  Description of Artificial Sequence: Synthetic oligonucleotide
caagcgtgacgagccctctcacagtg

SEQ ID NO: 420917 - DNA, 27 bp, Artificial Sequence
  Description of Artificial Sequence: Synthetic oligonucleotide
aagcgtgacgagccctctcacagtgga

SEQ ID NO: 420918 - DNA, 27 bp, Artificial Sequence
  Description of Artificial Sequence: Synthetic oligonucleotide
agcgtgacgagccctctcacagtggaa

SEQ ID NO: 420919 - DNA, 27 bp, Artificial Sequence
  Description of Artificial Sequence: Synthetic oligonucleotide
gcgtgacgagccctctcacagtggaat

SEQ ID NO: 420920 - DNA, 27 bp, Artificial Sequence
  Description of Artificial Sequence: Synthetic oligonucleotide
cgtgacgagccctctcacagtggaatg

SEQ ID NO: 420921 - DNA, 33 bp, Artificial Sequence; identical to SEQ ID NO: 72767
  Description of Artificial Sequence: Synthetic oligonucleotide

SEQ ID NO: 420922 - DNA, 34 bp, Artificial Sequence; identical to SEQ ID NO: 72768
  Description of Artificial Sequence: Synthetic oligonucleotide

SEQ ID NO: 420923 - DNA, 34 bp, Artificial Sequence; identical to SEQ ID NO: 72769
  Description of Artificial Sequence: Synthetic oligonucleotide

SEQ ID NO: 420924 - DNA, 35 bp, Artificial Sequence; identical to SEQ ID NO: 72770
  Description of Artificial Sequence: Synthetic oligonucleotide

SEQ ID NO: 420925 - DNA, 34 bp, Artificial Sequence; identical to SEQ ID NO: 72771
  Description of Artificial Sequence: Synthetic oligonucleotide

SEQ ID NO: 420926 - DNA, 34 bp, Artificial Sequence; identical to SEQ ID NO: 72772
  Description of Artificial Sequence: Synthetic oligonucleotide

SEQ ID NO: 420927 - DNA, 35 bp, Artificial Sequence; identical to SEQ ID NO: 72773
  Description of Artificial Sequence: Synthetic oligonucleotide

SEQ ID NO: 420928 - DNA, 36 bp, Artificial Sequence; identical to SEQ ID NO: 72774
  Description of Artificial Sequence: Synthetic oligonucleotide

SEQ ID NO: 420929 - DNA, 36 bp, Artificial Sequence; identical to SEQ ID NO: 72775
  Description of Artificial Sequence: Synthetic oligonucleotide

SEQ ID NO: 420930 - DNA, 35 bp, Artificial Sequence; identical to SEQ ID NO: 72776
  Description of Artificial Sequence: Synthetic oligonucleotide

SEQ ID NO: 420931 - DNA, 34 bp, Artificial Sequence; identical to SEQ ID NO: 72777
  Description of Artificial Sequence: Synthetic oligonucleotide

SEQ ID NO: 420932 - DNA, 34 bp, Artificial Sequence; identical to SEQ ID NO: 72778
  Description of Artificial Sequence: Synthetic oligonucleotide

SEQ ID NO: 420933 - DNA, 35 bp, Artificial Sequence; identical to SEQ ID NO: 72779
  Description of Artificial Sequence: Synthetic oligonucleotide

SEQ ID NO: 420934 - DNA, 34 bp, Artificial Sequence; identical to SEQ ID NO: 72780
  Description of Artificial Sequence: Synthetic oligonucleotide

SEQ ID NO: 420935 - DNA, 34 bp, Artificial Sequence; identical to SEQ ID NO: 72781
  Description of Artificial Sequence: Synthetic oligonucleotide

SEQ ID NO: 420936 - DNA, 34 bp, Artificial Sequence; identical to SEQ ID NO: 72782
  Description of Artificial Sequence: Synthetic oligonucleotide

SEQ ID NO: 420937 - DNA, 33 bp, Artificial Sequence; identical to SEQ ID NO: 72783
  Description of Artificial Sequence: Synthetic oligonucleotide

SEQ ID NO: 420938 - DNA, 33 bp, Artificial Sequence; identical to SEQ ID NO: 72784
  Description of Artificial Sequence: Synthetic oligonucleotide

SEQ ID NO: 420939 - DNA, 32 bp, Artificial Sequence; identical to SEQ ID NO: 72785
  Description of Artificial Sequence: Synthetic oligonucleotide

SEQ ID NO: 420940 - DNA, 34 bp, Artificial Sequence; identical to SEQ ID NO: 72786
  Description of Artificial Sequence: Synthetic oligonucleotide

SEQ ID NO: 420941 - DNA, 33 bp, Artificial Sequence; identical to SEQ ID NO: 72787
  Description of Artificial Sequence: Synthetic oligonucleotide

SEQ ID NO: 420942 - DNA, 32 bp, Artificial Sequence; identical to SEQ ID NO: 72788
  Description of Artificial Sequence: Synthetic oligonucleotide

SEQ ID NO: 420943 - DNA, 31 bp, Artificial Sequence; identical to SEQ ID NO: 72789
  Description of Artificial Sequence: Synthetic oligonucleotide

SEQ ID NO: 420944 - DNA, 31 bp, Artificial Sequence; identical to SEQ ID NO: 72790
  Description of Artificial Sequence: Synthetic oligonucleotide

SEQ ID NO: 420945 - DNA, 30 bp, Artificial Sequence; identical to SEQ ID NO: 72791
  Description of Artificial Sequence: Synthetic oligonucleotide

SEQ ID NO: 420946 - DNA, 29 bp, Artificial Sequence
  Description of Artificial Sequence: Synthetic oligonucleotide
ctataatcaggaggagtccgtgcgcttcg

SEQ ID NO: 420947 - DNA, 30 bp, Artificial Sequence; identical to SEQ ID NO: 72793
  Description of Artificial Sequence: Synthetic oligonucleotide

SEQ ID NO: 420948 - DNA, 29 bp, Artificial Sequence
  Description of Artificial Sequence: Synthetic oligonucleotide
ataatcaggaggagtccgtgcgcttcgac

SEQ ID NO: 420949 - DNA, 28 bp, Artificial Sequence
  Description of Artificial Sequence: Synthetic oligonucleotide
taatcaggaggagtccgtgcgcttcgac

SEQ ID NO: 420950 - DNA, 27 bp, Artificial Sequence
  Description of Artificial Sequence: Synthetic oligonucleotide
aatcaggaggagtccgtgcgcttcgac

SEQ ID NO: 420951 - DNA, 27 bp, Artificial Sequence
  Description of Artificial Sequence: Synthetic oligonucleotide
atcaggaggagtccgtgcgcttcgaca

SEQ ID NO: 420952 - DNA, 26 bp, Artificial Sequence
  Description of Artificial Sequence: Synthetic oligonucleotide
tcaggaggagtccgtgcgcttcgaca

SEQ ID NO: 420953 - DNA, 31 bp, Artificial Sequence; identical to SEQ ID NO: 72799
  Description of Artificial Sequence: Synthetic oligonucleotide

SEQ ID NO: 420954 - DNA, 32 bp, Artificial Sequence; identical to SEQ ID NO: 72800
  Description of Artificial Sequence: Synthetic oligonucleotide

SEQ ID NO: 420955 - DNA, 32 bp, Artificial Sequence; identical to SEQ ID NO: 72801
  Description of Artificial Sequence: Synthetic oligonucleotide

SEQ ID NO: 420956 - DNA, 31 bp, Artificial Sequence; identical to SEQ ID NO: 72802
  Description of Artificial Sequence: Synthetic oligonucleotide

SEQ ID NO: 420957 - DNA, 32 bp, Artificial Sequence; identical to SEQ ID NO: 72803
  Description of Artificial Sequence: Synthetic oligonucleotide

SEQ ID NO: 420958 - DNA, 31 bp, Artificial Sequence; identical to SEQ ID NO: 72804
  Description of Artificial Sequence: Synthetic oligonucleotide

SEQ ID NO: 420959 - DNA, 31 bp, Artificial Sequence; identical to SEQ ID NO: 72805
  Description of Artificial Sequence: Synthetic oligonucleotide

SEQ ID NO: 420960 - DNA, 30 bp, Artificial Sequence; identical to SEQ ID NO: 72806
  Description of Artificial Sequence: Synthetic oligonucleotide

SEQ ID NO: 420961 - DNA, 29 bp, Artificial Sequence
  Description of Artificial Sequence: Synthetic oligonucleotide
ctggaacagccagaaggacattctggagc

SEQ ID NO: 420962 - DNA, 30 bp, Artificial Sequence; identical to SEQ ID NO: 72808
  Description of Artificial Sequence: Synthetic oligonucleotide

SEQ ID NO: 420963 - DNA, 29 bp, Artificial Sequence
  Description of Artificial Sequence: Synthetic oligonucleotide
ggaacagccagaaggacattctggagcag

SEQ ID NO: 420964 - DNA, 29 bp, Artificial Sequence
  Description of Artificial Sequence: Synthetic oligonucleotide
gaacagccagaaggacattctggagcagg

SEQ ID NO: 420965 - DNA, 29 bp, Artificial Sequence
  Description of Artificial Sequence: Synthetic oligonucleotide
aacagccagaaggacattctggagcaggc

SEQ ID NO: 420966 - DNA, 28 bp, Artificial Sequence
  Description of Artificial Sequence: Synthetic oligonucleotide
acagccagaaggacattctggagcaggc

SEQ ID NO: 420967 - DNA, 27 bp, Artificial Sequence
  Description of Artificial Sequence: Synthetic oligonucleotide
cagccagaaggacattctggagcaggc

SEQ ID NO: 420968 - DNA, 27 bp, Artificial Sequence
  Description of Artificial Sequence: Synthetic oligonucleotide
agccagaaggacattctggagcaggcg

SEQ ID NO: 420969 - DNA, 26 bp, Artificial Sequence
  Description of Artificial Sequence: Synthetic oligonucleotide
gccagaaggacattctggagcaggcg

SEQ ID NO: 420970 - DNA, 26 bp, Artificial Sequence
  Description of Artificial Sequence: Synthetic oligonucleotide
ccagaaggacattctggagcaggcgc

SEQ ID NO: 420971 - DNA, 26 bp, Artificial Sequence
  Description of Artificial Sequence: Synthetic oligonucleotide
cagaaggacattctggagcaggcgcg

SEQ ID NO: 420972 - DNA, 26 bp, Artificial Sequence
  Description of Artificial Sequence: Synthetic oligonucleotide
agaaggacattctggagcaggcgcgg

SEQ ID NO: 420973 - DNA, 25 bp, Artificial Sequence
  Description of Artificial Sequence: Synthetic oligonucleotide
gaaggacattctggagcaggcgcgg

SEQ ID NO: 420974 - DNA, 25 bp, Artificial Sequence
  Description of Artificial Sequence: Synthetic oligonucleotide
aaggacattctggagcaggcgcggg

SEQ ID NO: 420975 - DNA, 24 bp, Artificial Sequence
  Description of Artificial Sequence: Synthetic oligonucleotide
aggacattctggagcaggcgcggg

SEQ ID NO: 420976 - DNA, 23 bp, Artificial Sequence
  Description of Artificial Sequence: Synthetic oligonucleotide
ggacattctggagcaggcgcggg

SEQ ID NO: 420977 - DNA, 23 bp, Artificial Sequence
  Description of Artificial Sequence: Synthetic oligonucleotide
gacattctggagcaggcgcgggc

SEQ ID NO: 420978 - DNA, 23 bp, Artificial Sequence
  Description of Artificial Sequence: Synthetic oligonucleotide
acattctggagcaggcgcgggcc

SEQ ID NO: 420979 - DNA, 22 bp, Artificial Sequence
  Description of Artificial Sequence: Synthetic oligonucleotide
cattctggagcaggcgcgggcc

SEQ ID NO: 420980 - DNA, 22 bp, Artificial Sequence
  Description of Artificial Sequence: Synthetic oligonucleotide
attctggagcaggcgcgggccg

SEQ ID NO: 420981 - DNA, 21 bp, Artificial Sequence
  Description of Artificial Sequence: Synthetic oligonucleotide
ttctggagcaggcgcgggccg

SEQ ID NO: 420982 - DNA, 20 bp, Artificial Sequence
  Description of Artificial Sequence: Synthetic oligonucleotide
tctggagcaggcgcgggccg

SEQ ID NO: 420983 - DNA, 27 bp, Artificial Sequence
  Description of Artificial Sequence: Synthetic oligonucleotide
gggtgcggttcctggacagacacttct

SEQ ID NO: 420984 - DNA, 31 bp, Artificial Sequence; identical to SEQ ID NO: 72830
  Description of Artificial Sequence: Synthetic oligonucleotide

SEQ ID NO: 420985 - DNA, 31 bp, Artificial Sequence; identical to SEQ ID NO: 72831
  Description of Artificial Sequence: Synthetic oligonucleotide

SEQ ID NO: 420986 - DNA, 32 bp, Artificial Sequence; identical to SEQ ID NO: 72832
  Description of Artificial Sequence: Synthetic oligonucleotide

SEQ ID NO: 420987 - DNA, 31 bp, Artificial Sequence; identical to SEQ ID NO: 72833
  Description of Artificial Sequence: Synthetic oligonucleotide

SEQ ID NO: 420988 - DNA, 31 bp, Artificial Sequence; identical to SEQ ID NO: 72834
  Description of Artificial Sequence: Synthetic oligonucleotide

SEQ ID NO: 420989 - DNA, 32 bp, Artificial Sequence; identical to SEQ ID NO: 72835
  Description of Artificial Sequence: Synthetic oligonucleotide

SEQ ID NO: 420990 - DNA, 32 bp, Artificial Sequence; identical to SEQ ID NO: 72836
  Description of Artificial Sequence: Synthetic oligonucleotide

SEQ ID NO: 420991 - DNA, 33 bp, Artificial Sequence; identical to SEQ ID NO: 72837
  Description of Artificial Sequence: Synthetic oligonucleotide

SEQ ID NO: 420992 - DNA, 32 bp, Artificial Sequence; identical to SEQ ID NO: 72838
  Description of Artificial Sequence: Synthetic oligonucleotide

SEQ ID NO: 420993 - DNA, 31 bp, Artificial Sequence; identical to SEQ ID NO: 72839
  Description of Artificial Sequence: Synthetic oligonucleotide

SEQ ID NO: 420994 - DNA, 32 bp, Artificial Sequence; identical to SEQ ID NO: 72840
  Description of Artificial Sequence: Synthetic oligonucleotide

SEQ ID NO: 420995 - DNA, 32 bp, Artificial Sequence; identical to SEQ ID NO: 72841
  Description of Artificial Sequence: Synthetic oligonucleotide

SEQ ID NO: 420996 - DNA, 31 bp, Artificial Sequence; identical to SEQ ID NO: 72842
  Description of Artificial Sequence: Synthetic oligonucleotide

SEQ ID NO: 420997 - DNA, 31 bp, Artificial Sequence; identical to SEQ ID NO: 72843
  Description of Artificial Sequence: Synthetic oligonucleotide

SEQ ID NO: 420998 - DNA, 32 bp, Artificial Sequence; identical to SEQ ID NO: 72844
  Description of Artificial Sequence: Synthetic oligonucleotide

SEQ ID NO: 420999 - DNA, 31 bp, Artificial Sequence; identical to SEQ ID NO: 72845
  Description of Artificial Sequence: Synthetic oligonucleotide

SEQ ID NO: 421000 - DNA, 31 bp, Artificial Sequence; identical to SEQ ID NO: 72846
  Description of Artificial Sequence: Synthetic oligonucleotide

SEQ ID NO: 421001 - DNA, 30 bp, Artificial Sequence; identical to SEQ ID NO: 72847
  Description of Artificial Sequence: Synthetic oligonucleotide

SEQ ID NO: 421002 - DNA, 30 bp, Artificial Sequence; identical to SEQ ID NO: 72848
  Description of Artificial Sequence: Synthetic oligonucleotide

SEQ ID NO: 421003 - DNA, 29 bp, Artificial Sequence
  Description of Artificial Sequence: Synthetic oligonucleotide
cacttctataaccaggaggagtccgtgcg

SEQ ID NO: 421004 - DNA, 25 bp, Artificial Sequence
  Description of Artificial Sequence: Synthetic oligonucleotide
ggagagggtgcggttcctggacaga

SEQ ID NO: 421005 - DNA, 26 bp, Artificial Sequence
  Description of Artificial Sequence: Synthetic oligonucleotide
gagagggtgcggttcctggacagaca

SEQ ID NO: 421006 - DNA, 27 bp, Artificial Sequence
  Description of Artificial Sequence: Synthetic oligonucleotide
agagggtgcggttcctggacagacact

SEQ ID NO: 421007 - DNA, 27 bp, Artificial Sequence
  Description of Artificial Sequence: Synthetic oligonucleotide
gagggtgcggttcctggacagacactt

SEQ ID NO: 421008 - DNA, 27 bp, Artificial Sequence
  Description of Artificial Sequence: Synthetic oligonucleotide
agggtgcggttcctggacagacacttc

SEQ ID NO: 421009 - DNA, 21 bp, Artificial Sequence
  Description of Artificial Sequence: Synthetic oligonucleotide
acgtgggggagttccgggcgg

SEQ ID NO: 421010 - DNA, 20 bp, Artificial Sequence
  Description of Artificial Sequence: Synthetic oligonucleotide
cgtgggggagttccgggcgg

SEQ ID NO: 421011 - DNA, 20 bp, Artificial Sequence
  Description of Artificial Sequence: Synthetic oligonucleotide
gtgggggagttccgggcggc

SEQ ID NO: 421012 - DNA, 21 bp, Artificial Sequence
  Description of Artificial Sequence: Synthetic oligonucleotide
tgggggagttccgggcggcga

SEQ ID NO: 421013 - DNA, 20 bp, Artificial Sequence
  Description of Artificial Sequence: Synthetic oligonucleotide
gggggagttccgggcggcga

SEQ ID NO: 421014 - DNA, 20 bp, Artificial Sequence
  Description of Artificial Sequence: Synthetic oligonucleotide
ggggagttccgggcggcgac

SEQ ID NO: 421015 - DNA, 20 bp, Artificial Sequence
  Description of Artificial Sequence: Synthetic oligonucleotide
gggagttccgggcggcgacg

SEQ ID NO: 421016 - DNA, 21 bp, Artificial Sequence
  Description of Artificial Sequence: Synthetic oligonucleotide
ggagttccgggcggcgacgga

SEQ ID NO: 421017 - DNA, 21 bp, Artificial Sequence
  Description of Artificial Sequence: Synthetic oligonucleotide
gagttccgggcggcgacggag

SEQ ID NO: 421018 - DNA, 22 bp, Artificial Sequence
  Description of Artificial Sequence: Synthetic oligonucleotide
agttccgggcggcgacggagct

SEQ ID NO: 421019 - DNA, 21 bp, Artificial Sequence
  Description of Artificial Sequence: Synthetic oligonucleotide
gttccgggcggcgacggagct

SEQ ID NO: 421020 - DNA, 21 bp, Artificial Sequence
  Description of Artificial Sequence: Synthetic oligonucleotide
ttccgggcggcgacggagctg

SEQ ID NO: 421021 - DNA, 20 bp, Artificial Sequence
  Description of Artificial Sequence: Synthetic oligonucleotide
tccgggcggcgacggagctg

SEQ ID NO: 421022 - DNA, 20 bp, Artificial Sequence
  Description of Artificial Sequence: Synthetic oligonucleotide
ccgggcggcgacggagctgt

SEQ ID NO: 421023 - DNA, 20 bp, Artificial Sequence
  Description of Artificial Sequence: Synthetic oligonucleotide
cgggcggcgacggagctggt

SEQ ID NO: 421024 - DNA, 20 bp, Artificial Sequence
  Description of Artificial Sequence: Synthetic oligonucleotide
gggcggcgacggagctgggt

SEQ ID NO: 421025 - DNA, 20 bp, Artificial Sequence
  Description of Artificial Sequence: Synthetic oligonucleotide
ggcggcgacggagctggggt

SEQ ID NO: 421026 - DNA, 20 bp, Artificial Sequence
  Description of Artificial Sequence: Synthetic oligonucleotide
gcggcgacggagctggggct

SEQ ID NO: 421027 - DNA, 20 bp, Artificial Sequence
  Description of Artificial Sequence: Synthetic oligonucleotide
cggcgacggagctggggcgt

SEQ ID NO: 421028 - DNA, 20 bp, Artificial Sequence
  Description of Artificial Sequence: Synthetic oligonucleotide
ggcgacggagctggggcggt

SEQ ID NO: 421029 - DNA, 20 bp, Artificial Sequence
  Description of Artificial Sequence: Synthetic oligonucleotide
gcgacggagctggggcggct

SEQ ID NO: 421030 - DNA, 20 bp, Artificial Sequence
  Description of Artificial Sequence: Synthetic oligonucleotide
cgacggagctggggcggcct

SEQ ID NO: 421031 - DNA, 31 bp, Artificial Sequence; identical to SEQ ID NO: 72872
  Description of Artificial Sequence: Synthetic oligonucleotide

SEQ ID NO: 421032 - DNA, 30 bp, Artificial Sequence; identical to SEQ ID NO: 72873
  Description of Artificial Sequence: Synthetic oligonucleotide

SEQ ID NO: 421033 - DNA, 32 bp, Artificial Sequence; identical to SEQ ID NO: 72874
  Description of Artificial Sequence: Synthetic oligonucleotide

SEQ ID NO: 421034 - DNA, 31 bp, Artificial Sequence; identical to SEQ ID NO: 72875
  Description of Artificial Sequence: Synthetic oligonucleotide

SEQ ID NO: 421035 - DNA, 31 bp, Artificial Sequence; identical to SEQ ID NO: 72876
  Description of Artificial Sequence: Synthetic oligonucleotide

SEQ ID NO: 421036 - DNA, 32 bp, Artificial Sequence; identical to SEQ ID NO: 72877
  Description of Artificial Sequence: Synthetic oligonucleotide

SEQ ID NO: 421037 - DNA, 32 bp, Artificial Sequence; identical to SEQ ID NO: 72878
  Description of Artificial Sequence: Synthetic oligonucleotide

SEQ ID NO: 421038 - DNA, 31 bp, Artificial Sequence; identical to SEQ ID NO: 72879
  Description of Artificial Sequence: Synthetic oligonucleotide

SEQ ID NO: 421039 - DNA, 32 bp, Artificial Sequence; identical to SEQ ID NO: 72880
  Description of Artificial Sequence: Synthetic oligonucleotide

SEQ ID NO: 421040 - DNA, 31 bp, Artificial Sequence; identical to SEQ ID NO: 72881
  Description of Artificial Sequence: Synthetic oligonucleotide

SEQ ID NO: 421041 - DNA, 31 bp, Artificial Sequence; identical to SEQ ID NO: 72882
  Description of Artificial Sequence: Synthetic oligonucleotide

SEQ ID NO: 421042 - DNA, 30 bp, Artificial Sequence; identical to SEQ ID NO: 72883
  Description of Artificial Sequence: Synthetic oligonucleotide

SEQ ID NO: 421043 - DNA, 29 bp, Artificial Sequence
  Description of Artificial Sequence: Synthetic oligonucleotide
ctggaacagccagaagaacatcctggagc

SEQ ID NO: 421044 - DNA, 30 bp, Artificial Sequence; identical to SEQ ID NO: 72885
  Description of Artificial Sequence: Synthetic oligonucleotide

SEQ ID NO: 421045 - DNA, 29 bp, Artificial Sequence
  Description of Artificial Sequence: Synthetic oligonucleotide
ggaacagccagaagaacatcctggagcag

SEQ ID NO: 421046 - DNA, 29 bp, Artificial Sequence
  Description of Artificial Sequence: Synthetic oligonucleotide
gaacagccagaagaacatcctggagcagg

SEQ ID NO: 421047 - DNA, 29 bp, Artificial Sequence
  Description of Artificial Sequence: Synthetic oligonucleotide
aacagccagaagaacatcctggagcaggc

SEQ ID NO: 421048 - DNA, 28 bp, Artificial Sequence
  Description of Artificial Sequence: Synthetic oligonucleotide
acagccagaagaacatcctggagcaggc

SEQ ID NO: 421049 - DNA, 27 bp, Artificial Sequence
  Description of Artificial Sequence: Synthetic oligonucleotide
cagccagaagaacatcctggagcaggc

SEQ ID NO: 421050 - DNA, 27 bp, Artificial Sequence
  Description of Artificial Sequence: Synthetic oligonucleotide
agccagaagaacatcctggagcaggcg

SEQ ID NO: 421051 - DNA, 26 bp, Artificial Sequence
  Description of Artificial Sequence: Synthetic oligonucleotide
gccagaagaacatcctggagcaggcg

SEQ ID NO: 421052 - DNA, 26 bp, Artificial Sequence
  Description of Artificial Sequence: Synthetic oligonucleotide
ccagaagaacatcctggagcaggcgc

SEQ ID NO: 421053 - DNA, 26 bp, Artificial Sequence
  Description of Artificial Sequence: Synthetic oligonucleotide
cagaagaacatcctggagcaggcgcg

SEQ ID NO: 421054 - DNA, 26 bp, Artificial Sequence
  Description of Artificial Sequence: Synthetic oligonucleotide
agaagaacatcctggagcaggcgcgg

SEQ ID NO: 421055 - DNA, 25 bp, Artificial Sequence
  Description of Artificial Sequence: Synthetic oligonucleotide
gaagaacatcctggagcaggcgcgg

SEQ ID NO: 421056 - DNA, 25 bp, Artificial Sequence
  Description of Artificial Sequence: Synthetic oligonucleotide
aagaacatcctggagcaggcgcggg

SEQ ID NO: 421057 - DNA, 24 bp, Artificial Sequence
  Description of Artificial Sequence: Synthetic oligonucleotide
agaacatcctggagcaggcgcggg

SEQ ID NO: 421058 - DNA, 23 bp, Artificial Sequence
  Description of Artificial Sequence: Synthetic oligonucleotide
gaacatcctggagcaggcgcggg

SEQ ID NO: 421059 - DNA, 23 bp, Artificial Sequence
  Description of Artificial Sequence: Synthetic oligonucleotide
aacatcctggagcaggcgcgggc

SEQ ID NO: 421060 - DNA, 26 bp, Artificial Sequence
  Description of Artificial Sequence: Synthetic oligonucleotide
ttcgacagcgacgtgggggagttcca

SEQ ID NO: 421061 - DNA, 25 bp, Artificial Sequence
  Description of Artificial Sequence: Synthetic oligonucleotide
tcgacagcgacgtgggggagttcca

SEQ ID NO: 421062 - DNA, 24 bp, Artificial Sequence
  Description of Artificial Sequence: Synthetic oligonucleotide
cgacagcgacgtgggggagttcca

SEQ ID NO: 421063 - DNA, 24 bp, Artificial Sequence
  Description of Artificial Sequence: Synthetic oligonucleotide
gacagcgacgtgggggagttccag

SEQ ID NO: 421064 - DNA, 24 bp, Artificial Sequence
  Description of Artificial Sequence: Synthetic oligonucleotide
acagcgacgtgggggagttccagg

SEQ ID NO: 421065 - DNA, 23 bp, Artificial Sequence
  Description of Artificial Sequence: Synthetic oligonucleotide
cagcgacgtgggggagttccagg

SEQ ID NO: 421066 - DNA, 23 bp, Artificial Sequence
  Description of Artificial Sequence: Synthetic oligonucleotide
agcgacgtgggggagttccaggc

SEQ ID NO: 421067 - DNA, 22 bp, Artificial Sequence
  Description of Artificial Sequence: Synthetic oligonucleotide
gcgacgtgggggagttccaggc

SEQ ID NO: 421068 - DNA, 22 bp, Artificial Sequence
  Description of Artificial Sequence: Synthetic oligonucleotide
cgacgtgggggagttccaggcg

SEQ ID NO: 421069 - DNA, 23 bp, Artificial Sequence
  Description of Artificial Sequence: Synthetic oligonucleotide
gacgtgggggagttccaggcggt

SEQ ID NO: 421070 - DNA, 24 bp, Artificial Sequence
  Description of Artificial Sequence: Synthetic oligonucleotide
acgtgggggagttccaggcggtga

SEQ ID NO: 421071 - DNA, 23 bp, Artificial Sequence
  Description of Artificial Sequence: Synthetic oligonucleotide
cgtgggggagttccaggcggtga

SEQ ID NO: 421072 - DNA, 23 bp, Artificial Sequence
  Description of Artificial Sequence: Synthetic oligonucleotide
gtgggggagttccaggcggtgac

SEQ ID NO: 421073 - DNA, 23 bp, Artificial Sequence
  Description of Artificial Sequence: Synthetic oligonucleotide
tgggggagttccaggcggtgacg

SEQ ID NO: 421074 - DNA, 22 bp, Artificial Sequence
  Description of Artificial Sequence: Synthetic oligonucleotide
gggggagttccaggcggtgacg

SEQ ID NO: 421075 - DNA, 23 bp, Artificial Sequence
  Description of Artificial Sequence: Synthetic oligonucleotide
ggggagttccaggcggtgacgga

SEQ ID NO: 421076 - DNA, 23 bp, Artificial Sequence
  Description of Artificial Sequence: Synthetic oligonucleotide
gggagttccaggcggtgacggag

SEQ ID NO: 421077 - DNA, 24 bp, Artificial Sequence
  Description of Artificial Sequence: Synthetic oligonucleotide
ggagttccaggcggtgacggagct

SEQ ID NO: 421078 - DNA, 24 bp, Artificial Sequence
  Description of Artificial Sequence: Synthetic oligonucleotide
gagttccaggcggtgacggagctg

SEQ ID NO: 421079 - DNA, 24 bp, Artificial Sequence
  Description of Artificial Sequence: Synthetic oligonucleotide
agttccaggcggtgacggagctgg

SEQ ID NO: 421080 - DNA, 23 bp, Artificial Sequence
  Description of Artificial Sequence: Synthetic oligonucleotide
gttccaggcggtgacggagctgg

SEQ ID NO: 421081 - DNA, 23 bp, Artificial Sequence
  Description of Artificial Sequence: Synthetic oligonucleotide
ttccaggcggtgacggagctggg

SEQ ID NO: 421082 - DNA, 22 bp, Artificial Sequence
  Description of Artificial Sequence: Synthetic oligonucleotide
tccaggcggtgacggagctggg

SEQ ID NO: 421083 - DNA, 27 bp, Artificial Sequence
  Description of Artificial Sequence: Synthetic oligonucleotide
ctgacgctgagtactggaacagccagg

SEQ ID NO: 421084 - DNA, 28 bp, Artificial Sequence
  Description of Artificial Sequence: Synthetic oligonucleotide
tgacgctgagtactggaacagccaggac

SEQ ID NO: 421085 - DNA, 27 bp, Artificial Sequence
  Description of Artificial Sequence: Synthetic oligonucleotide
gacgctgagtactggaacagccaggac

SEQ ID NO: 421086 - DNA, 29 bp, Artificial Sequence
  Description of Artificial Sequence: Synthetic oligonucleotide
acgctgagtactggaacagccaggacatc

SEQ ID NO: 421087 - DNA, 28 bp, Artificial Sequence
  Description of Artificial Sequence: Synthetic oligonucleotide
cgctgagtactggaacagccaggacatc

SEQ ID NO: 421088 - DNA, 28 bp, Artificial Sequence
  Description of Artificial Sequence: Synthetic oligonucleotide
gctgagtactggaacagccaggacatcc

SEQ ID NO: 421089 - DNA, 29 bp, Artificial Sequence
  Description of Artificial Sequence: Synthetic oligonucleotide
ctgagtactggaacagccaggacatcctg

SEQ ID NO: 421090 - DNA, 29 bp, Artificial Sequence
  Description of Artificial Sequence: Synthetic oligonucleotide
tgagtactggaacagccaggacatcctgg

SEQ ID NO: 421091 - DNA, 28 bp, Artificial Sequence
  Description of Artificial Sequence: Synthetic oligonucleotide
gagtactggaacagccaggacatcctgg

SEQ ID NO: 421092 - DNA, 29 bp, Artificial Sequence
  Description of Artificial Sequence: Synthetic oligonucleotide
agtactggaacagccaggacatcctggag

SEQ ID NO: 421093 - DNA, 28 bp, Artificial Sequence
  Description of Artificial Sequence: Synthetic oligonucleotide
gtactggaacagccaggacatcctggag

SEQ ID NO: 421094 - DNA, 28 bp, Artificial Sequence
  Description of Artificial Sequence: Synthetic oligonucleotide
tactggaacagccaggacatcctggagc

SEQ ID NO: 421095 - DNA, 27 bp, Artificial Sequence
  Description of Artificial Sequence: Synthetic oligonucleotide
actggaacagccaggacatcctggagc

SEQ ID NO: 421096 - DNA, 27 bp, Artificial Sequence
  Description of Artificial Sequence: Synthetic oligonucleotide
ctggaacagccaggacatcctggagca

SEQ ID NO: 421097 - DNA, 27 bp, Artificial Sequence
  Description of Artificial Sequence: Synthetic oligonucleotide
tggaacagccaggacatcctggagcag

SEQ ID NO: 421098 - DNA, 26 bp, Artificial Sequence
  Description of Artificial Sequence: Synthetic oligonucleotide
ggaacagccaggacatcctggagcag

SEQ ID NO: 421099 - DNA, 26 bp, Artificial Sequence
  Description of Artificial Sequence: Synthetic oligonucleotide
gaacagccaggacatcctggagcagg

SEQ ID NO: 421100 - DNA, 26 bp, Artificial Sequence
  Description of Artificial Sequence: Synthetic oligonucleotide
aacagccaggacatcctggagcaggc

SEQ ID NO: 421101 - DNA, 25 bp, Artificial Sequence
  Description of Artificial Sequence: Synthetic oligonucleotide
acagccaggacatcctggagcaggc

SEQ ID NO: 421102 - DNA, 24 bp, Artificial Sequence
  Description of Artificial Sequence: Synthetic oligonucleotide
cagccaggacatcctggagcaggc

SEQ ID NO: 421103 - DNA, 24 bp, Artificial Sequence
  Description of Artificial Sequence: Synthetic oligonucleotide
agccaggacatcctggagcaggcg

SEQ ID NO: 421104 - DNA, 23 bp, Artificial Sequence
  Description of Artificial Sequence: Synthetic oligonucleotide
gccaggacatcctggagcaggcg

SEQ ID NO: 421105 - DNA, 23 bp, Artificial Sequence
  Description of Artificial Sequence: Synthetic oligonucleotide
ccaggacatcctggagcaggcgc

SEQ ID NO: 421106 - DNA, 23 bp, Artificial Sequence
  Description of Artificial Sequence: Synthetic oligonucleotide
caggacatcctggagcaggcgcg

SEQ ID NO: 421107 - DNA, 33 bp, Artificial Sequence; identical to SEQ ID NO: 72948
  Description of Artificial Sequence: Synthetic oligonucleotide

SEQ ID NO: 421108 - DNA, 33 bp, Artificial Sequence; identical to SEQ ID NO: 72949
  Description of Artificial Sequence: Synthetic oligonucleotide

SEQ ID NO: 421109 - DNA, 34 bp, Artificial Sequence; identical to SEQ ID NO: 72950
  Description of Artificial Sequence: Synthetic oligonucleotide

SEQ ID NO: 421110 - DNA, 33 bp, Artificial Sequence; identical to SEQ ID NO: 72951
  Description of Artificial Sequence: Synthetic oligonucleotide

SEQ ID NO: 421111 - DNA, 33 bp, Artificial Sequence; identical to SEQ ID NO: 72952
  Description of Artificial Sequence: Synthetic oligonucleotide

SEQ ID NO: 421112 - DNA, 33 bp, Artificial Sequence; identical to SEQ ID NO: 72953
  Description of Artificial Sequence: Synthetic oligonucleotide

SEQ ID NO: 421113 - DNA, 34 bp, Artificial Sequence; identical to SEQ ID NO: 72954
  Description of Artificial Sequence: Synthetic oligonucleotide

SEQ ID NO: 421114 - DNA, 33 bp, Artificial Sequence; identical to SEQ ID NO: 72955
  Description of Artificial Sequence: Synthetic oligonucleotide

SEQ ID NO: 421115 - DNA, 32 bp, Artificial Sequence; identical to SEQ ID NO: 72956
  Description of Artificial Sequence: Synthetic oligonucleotide

SEQ ID NO: 421116 - DNA, 31 bp, Artificial Sequence; identical to SEQ ID NO: 72957
  Description of Artificial Sequence: Synthetic oligonucleotide

SEQ ID NO: 421117 - DNA, 31 bp, Artificial Sequence; identical to SEQ ID NO: 72958
  Description of Artificial Sequence: Synthetic oligonucleotide

SEQ ID NO: 421118 - DNA, 30 bp, Artificial Sequence; identical to SEQ ID NO: 72959
  Description of Artificial Sequence: Synthetic oligonucleotide

SEQ ID NO: 421119 - DNA, 30 bp, Artificial Sequence; identical to SEQ ID NO: 72960
  Description of Artificial Sequence: Synthetic oligonucleotide

SEQ ID NO: 421120 - DNA, 26 bp, Artificial Sequence
  Description of Artificial Sequence: Synthetic oligonucleotide
cgcttcgacagcgacgtgagggagtt

SEQ ID NO: 421121 - DNA, 26 bp, Artificial Sequence
  Description of Artificial Sequence: Synthetic oligonucleotide
gcttcgacagcgacgtgagggagttc

SEQ ID NO: 421122 - DNA, 26 bp, Artificial Sequence
  Description of Artificial Sequence: Synthetic oligonucleotide
cttcgacagcgacgtgagggagttcc

SEQ ID NO: 421123 - DNA, 26 bp, Artificial Sequence
  Description of Artificial Sequence: Synthetic oligonucleotide
ttcgacagcgacgtgagggagttccg

SEQ ID NO: 421124 - DNA, 25 bp, Artificial Sequence
  Description of Artificial Sequence: Synthetic oligonucleotide
tcgacagcgacgtgagggagttccg

SEQ ID NO: 421125 - DNA, 24 bp, Artificial Sequence
  Description of Artificial Sequence: Synthetic oligonucleotide
cgacagcgacgtgagggagttccg

SEQ ID NO: 421126 - DNA, 24 bp, Artificial Sequence
  Description of Artificial Sequence: Synthetic oligonucleotide
gacagcgacgtgagggagttccgg

SEQ ID NO: 421127 - DNA, 24 bp, Artificial Sequence
  Description of Artificial Sequence: Synthetic oligonucleotide
acagcgacgtgagggagttccggg

SEQ ID NO: 421128 - DNA, 23 bp, Artificial Sequence
  Description of Artificial Sequence: Synthetic oligonucleotide
cagcgacgtgagggagttccggg

SEQ ID NO: 421129 - DNA, 23 bp, Artificial Sequence
  Description of Artificial Sequence: Synthetic oligonucleotide
agcgacgtgagggagttccgggc

SEQ ID NO: 421130 - DNA, 22 bp, Artificial Sequence
  Description of Artificial Sequence: Synthetic oligonucleotide
gcgacgtgagggagttccgggc

SEQ ID NO: 421131 - DNA, 22 bp, Artificial Sequence
  Description of Artificial Sequence: Synthetic oligonucleotide
cgacgtgagggagttccgggcg

SEQ ID NO: 421132 - DNA, 23 bp, Artificial Sequence
  Description of Artificial Sequence: Synthetic oligonucleotide
gacgtgagggagttccgggcggt

SEQ ID NO: 421133 - DNA, 24 bp, Artificial Sequence
  Description of Artificial Sequence: Synthetic oligonucleotide
acgtgagggagttccgggcggtga

SEQ ID NO: 421134 - DNA, 23 bp, Artificial Sequence
  Description of Artificial Sequence: Synthetic oligonucleotide
cgtgagggagttccgggcggtga

SEQ ID NO: 421135 - DNA, 23 bp, Artificial Sequence
  Description of Artificial Sequence: Synthetic oligonucleotide
gtgagggagttccgggcggtgac

SEQ ID NO: 421136 - DNA, 23 bp, Artificial Sequence
  Description of Artificial Sequence: Synthetic oligonucleotide
tgagggagttccgggcggtgacg

SEQ ID NO: 421137 - DNA, 22 bp, Artificial Sequence
  Description of Artificial Sequence: Synthetic oligonucleotide
gagggagttccgggcggtgacg

SEQ ID NO: 421138 - DNA, 23 bp, Artificial Sequence
  Description of Artificial Sequence: Synthetic oligonucleotide
agggagttccgggcggtgacgga

SEQ ID NO: 421139 - DNA, 26 bp, Artificial Sequence
  Description of Artificial Sequence: Synthetic oligonucleotide
cagccagaaggacatcctggaggagg

SEQ ID NO: 421140 - DNA, 26 bp, Artificial Sequence
  Description of Artificial Sequence: Synthetic oligonucleotide
agccagaaggacatcctggaggaggc

SEQ ID NO: 421141 - DNA, 25 bp, Artificial Sequence
  Description of Artificial Sequence: Synthetic oligonucleotide
gccagaaggacatcctggaggaggc

SEQ ID NO: 421142 - DNA, 25 bp, Artificial Sequence
  Description of Artificial Sequence: Synthetic oligonucleotide
ccagaaggacatcctggaggaggcg

SEQ ID NO: 421143 - DNA, 25 bp, Artificial Sequence
  Description of Artificial Sequence: Synthetic oligonucleotide
cagaaggacatcctggaggaggcgc

SEQ ID NO: 421144 - DNA, 25 bp, Artificial Sequence
  Description of Artificial Sequence: Synthetic oligonucleotide
agaaggacatcctggaggaggcgcg

SEQ ID NO: 421145 - DNA, 24 bp, Artificial Sequence
  Description of Artificial Sequence: Synthetic oligonucleotide
gaaggacatcctggaggaggcgcg

SEQ ID NO: 421146 - DNA, 24 bp, Artificial Sequence
  Description of Artificial Sequence: Synthetic oligonucleotide
aaggacatcctggaggaggcgcgg

SEQ ID NO: 421147 - DNA, 23 bp, Artificial Sequence
  Description of Artificial Sequence: Synthetic oligonucleotide
aggacatcctggaggaggcgcgg

SEQ ID NO: 421148 - DNA, 22 bp, Artificial Sequence
  Description of Artificial Sequence: Synthetic oligonucleotide
ggacatcctggaggaggcgcgg

SEQ ID NO: 421149 - DNA, 22 bp, Artificial Sequence
  Description of Artificial Sequence: Synthetic oligonucleotide
gacatcctggaggaggcgcggg

SEQ ID NO: 421150 - DNA, 22 bp, Artificial Sequence
  Description of Artificial Sequence: Synthetic oligonucleotide
acatcctggaggaggcgcgggc

SEQ ID NO: 421151 - DNA, 21 bp, Artificial Sequence
  Description of Artificial Sequence: Synthetic oligonucleotide
catcctggaggaggcgcgggc

SEQ ID NO: 421152 - DNA, 21 bp, Artificial Sequence
  Description of Artificial Sequence: Synthetic oligonucleotide
atcctggaggaggcgcgggcc

SEQ ID NO: 421153 - DNA, 20 bp, Artificial Sequence
  Description of Artificial Sequence: Synthetic oligonucleotide
tcctggaggaggcgcgggcc

SEQ ID NO: 421154 - DNA, 20 bp, Artificial Sequence
  Description of Artificial Sequence: Synthetic oligonucleotide
cctggaggaggcgcgggcct

SEQ ID NO: 421155 - DNA, 20 bp, Artificial Sequence
  Description of Artificial Sequence: Synthetic oligonucleotide
ctggaggaggcgcgggccgt

SEQ ID NO: 421156 - DNA, 20 bp, Artificial Sequence
  Description of Artificial Sequence: Synthetic oligonucleotide
tggaggaggcgcgggccgct

SEQ ID NO: 421157 - DNA, 20 bp, Artificial Sequence
  Description of Artificial Sequence: Synthetic oligonucleotide
ggaggaggcgcgggccgctt

SEQ ID NO: 421158 - DNA, 20 bp, Artificial Sequence
  Description of Artificial Sequence: Synthetic oligonucleotide
gaggaggcgcgggccgcgtt

SEQ ID NO: 421159 - DNA, 20 bp, Artificial Sequence
  Description of Artificial Sequence: Synthetic oligonucleotide
aggaggcgcgggccgcggtt

SEQ ID NO: 421160 - DNA, 20 bp, Artificial Sequence
  Description of Artificial Sequence: Synthetic oligonucleotide
ggaggcgcgggccgcggttt

SEQ ID NO: 421161 - DNA, 20 bp, Artificial Sequence
  Description of Artificial Sequence: Synthetic oligonucleotide
gaggcgcgggccgcggtgtt

SEQ ID NO: 421162 - DNA, 27 bp, Artificial Sequence
  Description of Artificial Sequence: Synthetic oligonucleotide
caggtttcctgtggcagcctaagaggg

SEQ ID NO: 421163 - DNA, 28 bp, Artificial Sequence
  Description of Artificial Sequence: Synthetic oligonucleotide
aggtttcctgtggcagcctaagagggag

SEQ ID NO: 421164 - DNA, 27 bp, Artificial Sequence
  Description of Artificial Sequence: Synthetic oligonucleotide
ggtttcctgtggcagcctaagagggag

SEQ ID NO: 421165 - DNA, 32 bp, Artificial Sequence; identical to SEQ ID NO: 73043
  Description of Artificial Sequence: Synthetic oligonucleotide

SEQ ID NO: 421166 - DNA, 31 bp, Artificial Sequence; identical to SEQ ID NO: 73044
  Description of Artificial Sequence: Synthetic oligonucleotide

SEQ ID NO: 421167 - DNA, 31 bp, Artificial Sequence; identical to SEQ ID NO: 73045
  Description of Artificial Sequence: Synthetic oligonucleotide

SEQ ID NO: 421168 - DNA, 30 bp, Artificial Sequence; identical to SEQ ID NO: 73046
  Description of Artificial Sequence: Synthetic oligonucleotide

SEQ ID NO: 421169 - DNA, 31 bp, Artificial Sequence; identical to SEQ ID NO: 73047
  Description of Artificial Sequence: Synthetic oligonucleotide

SEQ ID NO: 421170 - DNA, 32 bp, Artificial Sequence; identical to SEQ ID NO: 73048
  Description of Artificial Sequence: Synthetic oligonucleotide

SEQ ID NO: 421171 - DNA, 31 bp, Artificial Sequence; identical to SEQ ID NO: 73049
  Description of Artificial Sequence: Synthetic oligonucleotide

SEQ ID NO: 421172 - DNA, 30 bp, Artificial Sequence; identical to SEQ ID NO: 73050
  Description of Artificial Sequence: Synthetic oligonucleotide

SEQ ID NO: 421173 - DNA, 30 bp, Artificial Sequence; identical to SEQ ID NO: 73051
  Description of Artificial Sequence: Synthetic oligonucleotide

SEQ ID NO: 421174 - DNA, 29 bp, Artificial Sequence
  Description of Artificial Sequence: Synthetic oligonucleotide
gcagacacaactacagggttgtggagagc

SEQ ID NO: 421175 - DNA, 31 bp, Artificial Sequence; identical to SEQ ID NO: 73053
  Description of Artificial Sequence: Synthetic oligonucleotide

SEQ ID NO: 421176 - DNA, 32 bp, Artificial Sequence; identical to SEQ ID NO: 73054
  Description of Artificial Sequence: Synthetic oligonucleotide

SEQ ID NO: 421177 - DNA, 31 bp, Artificial Sequence; identical to SEQ ID NO: 73055
  Description of Artificial Sequence: Synthetic oligonucleotide

SEQ ID NO: 421178 - DNA, 32 bp, Artificial Sequence; identical to SEQ ID NO: 73056
  Description of Artificial Sequence: Synthetic oligonucleotide

SEQ ID NO: 421179 - DNA, 31 bp, Artificial Sequence; identical to SEQ ID NO: 73057
  Description of Artificial Sequence: Synthetic oligonucleotide

SEQ ID NO: 421180 - DNA, 32 bp, Artificial Sequence; identical to SEQ ID NO: 73058
  Description of Artificial Sequence: Synthetic oligonucleotide

SEQ ID NO: 421181 - DNA, 31 bp, Artificial Sequence; identical to SEQ ID NO: 73059
  Description of Artificial Sequence: Synthetic oligonucleotide

SEQ ID NO: 421182 - DNA, 31 bp, Artificial Sequence; identical to SEQ ID NO: 73060
  Description of Artificial Sequence: Synthetic oligonucleotide

SEQ ID NO: 421183 - DNA, 30 bp, Artificial Sequence; identical to SEQ ID NO: 73061
  Description of Artificial Sequence: Synthetic oligonucleotide

SEQ ID NO: 421184 - DNA, 29 bp, Artificial Sequence
  Description of Artificial Sequence: Synthetic oligonucleotide
ctacagggttgtggagagcttcacagtgc

SEQ ID NO: 421185 - DNA, 30 bp, Artificial Sequence; identical to SEQ ID NO: 73063
  Description of Artificial Sequence: Synthetic oligonucleotide

SEQ ID NO: 421186 - DNA, 29 bp, Artificial Sequence
  Description of Artificial Sequence: Synthetic oligonucleotide
acagggttgtggagagcttcacagtgcag

SEQ ID NO: 421187 - DNA, 28 bp, Artificial Sequence
  Description of Artificial Sequence: Synthetic oligonucleotide
cagggttgtggagagcttcacagtgcag

SEQ ID NO: 421188 - DNA, 28 bp, Artificial Sequence
  Description of Artificial Sequence: Synthetic oligonucleotide
agggttgtggagagcttcacagtgcagc

SEQ ID NO: 421189 - DNA, 21 bp, Artificial Sequence
  Description of Artificial Sequence: Synthetic oligonucleotide
ggcggtgacggagctggggct

SEQ ID NO: 421190 - DNA, 21 bp, Artificial Sequence
  Description of Artificial Sequence: Synthetic oligonucleotide
gcggtgacggagctggggctg

SEQ ID NO: 421191 - DNA, 21 bp, Artificial Sequence
  Description of Artificial Sequence: Synthetic oligonucleotide
cggtgacggagctggggctgc

SEQ ID NO: 421192 - DNA, 22 bp, Artificial Sequence
  Description of Artificial Sequence: Synthetic oligonucleotide
ggtgacggagctggggctgcct

SEQ ID NO: 421193 - DNA, 23 bp, Artificial Sequence
  Description of Artificial Sequence: Synthetic oligonucleotide
gtgacggagctggggctgcctga

SEQ ID NO: 421194 - DNA, 23 bp, Artificial Sequence
  Description of Artificial Sequence: Synthetic oligonucleotide
tgacggagctggggctgcctgac

SEQ ID NO: 421195 - DNA, 22 bp, Artificial Sequence
  Description of Artificial Sequence: Synthetic oligonucleotide
gacggagctggggctgcctgac

SEQ ID NO: 421196 - DNA, 22 bp, Artificial Sequence
  Description of Artificial Sequence: Synthetic oligonucleotide
acggagctggggctgcctgacg

SEQ ID NO: 421197 - DNA, 21 bp, Artificial Sequence
  Description of Artificial Sequence: Synthetic oligonucleotide
cggagctggggctgcctgacg

SEQ ID NO: 421198 - DNA, 22 bp, Artificial Sequence
  Description of Artificial Sequence: Synthetic oligonucleotide
ggagctggggctgcctgacgct

SEQ ID NO: 421199 - DNA, 23 bp, Artificial Sequence
  Description of Artificial Sequence: Synthetic oligonucleotide
gagctggggctgcctgacgctga

SEQ ID NO: 421200 - DNA, 25 bp, Artificial Sequence
  Description of Artificial Sequence: Synthetic oligonucleotide
agctggggctgcctgacgctgagta

SEQ ID NO: 421201 - DNA, 24 bp, Artificial Sequence
  Description of Artificial Sequence: Synthetic oligonucleotide
gctggggctgcctgacgctgagta

SEQ ID NO: 421202 - DNA, 25 bp, Artificial Sequence
  Description of Artificial Sequence: Synthetic oligonucleotide
ctggggctgcctgacgctgagtact

SEQ ID NO: 421203 - DNA, 25 bp, Artificial Sequence
  Description of Artificial Sequence: Synthetic oligonucleotide
tggggctgcctgacgctgagtactg

SEQ ID NO: 421204 - DNA, 24 bp, Artificial Sequence
  Description of Artificial Sequence: Synthetic oligonucleotide
ggggctgcctgacgctgagtactg

SEQ ID NO: 421205 - DNA, 26 bp, Artificial Sequence
  Description of Artificial Sequence: Synthetic oligonucleotide
gggctgcctgacgctgagtactggaa

SEQ ID NO: 421206 - DNA, 27 bp, Artificial Sequence
  Description of Artificial Sequence: Synthetic oligonucleotide
ggctgcctgacgctgagtactggaaca

SEQ ID NO: 421207 - DNA, 27 bp, Artificial Sequence
  Description of Artificial Sequence: Synthetic oligonucleotide
gctgcctgacgctgagtactggaacag

SEQ ID NO: 421208 - DNA, 27 bp, Artificial Sequence
  Description of Artificial Sequence: Synthetic oligonucleotide
ctgcctgacgctgagtactggaacagc

SEQ ID NO: 421209 - DNA, 27 bp, Artificial Sequence
  Description of Artificial Sequence: Synthetic oligonucleotide
tgcctgacgctgagtactggaacagcc

SEQ ID NO: 421210 - DNA, 33 bp, Artificial Sequence; identical to SEQ ID NO: 73088
  Description of Artificial Sequence: Synthetic oligonucleotide

SEQ ID NO: 421211 - DNA, 33 bp, Artificial Sequence; identical to SEQ ID NO: 73089
  Description of Artificial Sequence: Synthetic oligonucleotide

SEQ ID NO: 421212 - DNA, 34 bp, Artificial Sequence; identical to SEQ ID NO: 73090
  Description of Artificial Sequence: Synthetic oligonucleotide

SEQ ID NO: 421213 - DNA, 34 bp, Artificial Sequence; identical to SEQ ID NO: 73091
  Description of Artificial Sequence: Synthetic oligonucleotide

SEQ ID NO: 421214 - DNA, 35 bp, Artificial Sequence; identical to SEQ ID NO: 73092
  Description of Artificial Sequence: Synthetic oligonucleotide

SEQ ID NO: 421215 - DNA, 34 bp, Artificial Sequence; identical to SEQ ID NO: 73093
  Description of Artificial Sequence: Synthetic oligonucleotide

SEQ ID NO: 421216 - DNA, 34 bp, Artificial Sequence; identical to SEQ ID NO: 73094
  Description of Artificial Sequence: Synthetic oligonucleotide

SEQ ID NO: 421217 - DNA, 35 bp, Artificial Sequence; identical to SEQ ID NO: 73095
  Description of Artificial Sequence: Synthetic oligonucleotide

SEQ ID NO: 421218 - DNA, 34 bp, Artificial Sequence; identical to SEQ ID NO: 73096
  Description of Artificial Sequence: Synthetic oligonucleotide

SEQ ID NO: 421219 - DNA, 33 bp, Artificial Sequence; identical to SEQ ID NO: 73097
  Description of Artificial Sequence: Synthetic oligonucleotide

SEQ ID NO: 421220 - DNA, 33 bp, Artificial Sequence; identical to SEQ ID NO: 73098
  Description of Artificial Sequence: Synthetic oligonucleotide

SEQ ID NO: 421221 - DNA, 33 bp, Artificial Sequence; identical to SEQ ID NO: 73099
  Description of Artificial Sequence: Synthetic oligonucleotide

SEQ ID NO: 421222 - DNA, 34 bp, Artificial Sequence; identical to SEQ ID NO: 73100
  Description of Artificial Sequence: Synthetic oligonucleotide

SEQ ID NO: 421223 - DNA, 33 bp, Artificial Sequence; identical to SEQ ID NO: 73101
  Description of Artificial Sequence: Synthetic oligonucleotide

SEQ ID NO: 421224 - DNA, 32 bp, Artificial Sequence; identical to SEQ ID NO: 73102
  Description of Artificial Sequence: Synthetic oligonucleotide

SEQ ID NO: 421225 - DNA, 31 bp, Artificial Sequence; identical to SEQ ID NO: 73103
  Description of Artificial Sequence: Synthetic oligonucleotide

SEQ ID NO: 421226 - DNA, 31 bp, Artificial Sequence; identical to SEQ ID NO: 73104
  Description of Artificial Sequence: Synthetic oligonucleotide

SEQ ID NO: 421227 - DNA, 30 bp, Artificial Sequence; identical to SEQ ID NO: 73105
  Description of Artificial Sequence: Synthetic oligonucleotide

SEQ ID NO: 421228 - DNA, 30 bp, Artificial Sequence; identical to SEQ ID NO: 73106
  Description of Artificial Sequence: Synthetic oligonucleotide

SEQ ID NO: 421229 - DNA, 30 bp, Artificial Sequence; identical to SEQ ID NO: 73107
  Description of Artificial Sequence: Synthetic oligonucleotide

SEQ ID NO: 421230 - DNA, 30 bp, Artificial Sequence; identical to SEQ ID NO: 73108
  Description of Artificial Sequence: Synthetic oligonucleotide

SEQ ID NO: 421231 - DNA, 29 bp, Artificial Sequence
  Description of Artificial Sequence: Synthetic oligonucleotide
gtgtcatttcttcaatgggtcggagcggg

SEQ ID NO: 421232 - DNA, 30 bp, Artificial Sequence; identical to SEQ ID NO: 73110
  Description of Artificial Sequence: Synthetic oligonucleotide

SEQ ID NO: 421233 - DNA, 29 bp, Artificial Sequence
  Description of Artificial Sequence: Synthetic oligonucleotide
gtcatttcttcaatgggtcggagcgggtg

SEQ ID NO: 421234 - DNA, 29 bp, Artificial Sequence
  Description of Artificial Sequence: Synthetic oligonucleotide
tcatttcttcaatgggtcggagcgggtgc

SEQ ID NO: 421235 - DNA, 28 bp, Artificial Sequence
  Description of Artificial Sequence: Synthetic oligonucleotide
catttcttcaatgggtcggagcgggtgc

SEQ ID NO: 421236 - DNA, 28 bp, Artificial Sequence
  Description of Artificial Sequence: Synthetic oligonucleotide
atttcttcaatgggtcggagcgggtgcg

SEQ ID NO: 421237 - DNA, 27 bp, Artificial Sequence
  Description of Artificial Sequence: Synthetic oligonucleotide
tttcttcaatgggtcggagcgggtgcg

SEQ ID NO: 421238 - DNA, 26 bp, Artificial Sequence
  Description of Artificial Sequence: Synthetic oligonucleotide
ttcttcaatgggtcggagcgggtgcg

SEQ ID NO: 421239 - DNA, 25 bp, Artificial Sequence
  Description of Artificial Sequence: Synthetic oligonucleotide
tcttcaatgggtcggagcgggtgcg

SEQ ID NO: 421240 - DNA, 24 bp, Artificial Sequence
  Description of Artificial Sequence: Synthetic oligonucleotide
cttcaatgggtcggagcgggtgcg

SEQ ID NO: 421241 - DNA, 26 bp, Artificial Sequence
  Description of Artificial Sequence: Synthetic oligonucleotide
ttcaatgggtcggagcgggtgcggtt

SEQ ID NO: 421242 - DNA, 25 bp, Artificial Sequence
  Description of Artificial Sequence: Synthetic oligonucleotide
tcaatgggtcggagcgggtgcggtt

SEQ ID NO: 421243 - DNA, 24 bp, Artificial Sequence
  Description of Artificial Sequence: Synthetic oligonucleotide
caatgggtcggagcgggtgcggtt

SEQ ID NO: 421244 - DNA, 24 bp, Artificial Sequence
  Description of Artificial Sequence: Synthetic oligonucleotide
aatgggtcggagcgggtgcggttc

SEQ ID NO: 421245 - DNA, 23 bp, Artificial Sequence
  Description of Artificial Sequence: Synthetic oligonucleotide
atgggtcggagcgggtgcggttc

SEQ ID NO: 421246 - DNA, 22 bp, Artificial Sequence
  Description of Artificial Sequence: Synthetic oligonucleotide
tgggtcggagcgggtgcggttc

SEQ ID NO: 421247 - DNA, 21 bp, Artificial Sequence
  Description of Artificial Sequence: Synthetic oligonucleotide
gggtcggagcgggtgcggttc

SEQ ID NO: 421248 - DNA, 22 bp, Artificial Sequence
  Description of Artificial Sequence: Synthetic oligonucleotide
ggtcggagcgggtgcggttcct

SEQ ID NO: 421249 - DNA, 22 bp, Artificial Sequence
  Description of Artificial Sequence: Synthetic oligonucleotide
gtcggagcgggtgcggttcctg

SEQ ID NO: 421250 - DNA, 23 bp, Artificial Sequence
  Description of Artificial Sequence: Synthetic oligonucleotide
tcggagcgggtgcggttcctgga

SEQ ID NO: 421251 - DNA, 29 bp, Artificial Sequence
  Description of Artificial Sequence: Synthetic oligonucleotide
cacgtttcctgtggcagcctaagaaggag

SEQ ID NO: 421252 - DNA, 30 bp, Artificial Sequence; identical to SEQ ID NO: 73130
  Description of Artificial Sequence: Synthetic oligonucleotide

SEQ ID NO: 421253 - DNA, 29 bp, Artificial Sequence
  Description of Artificial Sequence: Synthetic oligonucleotide
cgtttcctgtggcagcctaagaaggagtg

SEQ ID NO: 421254 - DNA, 30 bp, Artificial Sequence; identical to SEQ ID NO: 73132
  Description of Artificial Sequence: Synthetic oligonucleotide

SEQ ID NO: 421255 - DNA, 34 bp, Artificial Sequence; identical to SEQ ID NO: 73133
  Description of Artificial Sequence: Synthetic oligonucleotide

SEQ ID NO: 421256 - DNA, 33 bp, Artificial Sequence; identical to SEQ ID NO: 73134
  Description of Artificial Sequence: Synthetic oligonucleotide

SEQ ID NO: 421257 - DNA, 32 bp, Artificial Sequence; identical to SEQ ID NO: 73135
  Description of Artificial Sequence: Synthetic oligonucleotide

SEQ ID NO: 421258 - DNA, 31 bp, Artificial Sequence; identical to SEQ ID NO: 73136
  Description of Artificial Sequence: Synthetic oligonucleotide

SEQ ID NO: 421259 - DNA, 33 bp, Artificial Sequence; identical to SEQ ID NO: 73137
  Description of Artificial Sequence: Synthetic oligonucleotide

SEQ ID NO: 421260 - DNA, 36 bp, Artificial Sequence; identical to SEQ ID NO: 73138
  Description of Artificial Sequence: Synthetic oligonucleotide

SEQ ID NO: 421261 - DNA, 35 bp, Artificial Sequence; identical to SEQ ID NO: 73139
  Description of Artificial Sequence: Synthetic oligonucleotide

SEQ ID NO: 421262 - DNA, 35 bp, Artificial Sequence; identical to SEQ ID NO: 73140
  Description of Artificial Sequence: Synthetic oligonucleotide

SEQ ID NO: 421263 - DNA, 34 bp, Artificial Sequence; identical to SEQ ID NO: 73141
  Description of Artificial Sequence: Synthetic oligonucleotide

SEQ ID NO: 421264 - DNA, 34 bp, Artificial Sequence; identical to SEQ ID NO: 73142
  Description of Artificial Sequence: Synthetic oligonucleotide

SEQ ID NO: 421265 - DNA, 35 bp, Artificial Sequence; identical to SEQ ID NO: 73143
  Description of Artificial Sequence: Synthetic oligonucleotide

SEQ ID NO: 421266 - DNA, 35 bp, Artificial Sequence; identical to SEQ ID NO: 73144
  Description of Artificial Sequence: Synthetic oligonucleotide

SEQ ID NO: 421267 - DNA, 34 bp, Artificial Sequence; identical to SEQ ID NO: 73145
  Description of Artificial Sequence: Synthetic oligonucleotide

SEQ ID NO: 421268 - DNA, 34 bp, Artificial Sequence; identical to SEQ ID NO: 73146
  Description of Artificial Sequence: Synthetic oligonucleotide

SEQ ID NO: 421269 - DNA, 35 bp, Artificial Sequence; identical to SEQ ID NO: 73147
  Description of Artificial Sequence: Synthetic oligonucleotide

SEQ ID NO: 421270 - DNA, 35 bp, Artificial Sequence; identical to SEQ ID NO: 73148
  Description of Artificial Sequence: Synthetic oligonucleotide

SEQ ID NO: 421271 - DNA, 34 bp, Artificial Sequence; identical to SEQ ID NO: 73149
  Description of Artificial Sequence: Synthetic oligonucleotide

SEQ ID NO: 421272 - DNA, 33 bp, Artificial Sequence; identical to SEQ ID NO: 73150
  Description of Artificial Sequence: Synthetic oligonucleotide

SEQ ID NO: 421273 - DNA, 32 bp, Artificial Sequence; identical to SEQ ID NO: 73151
  Description of Artificial Sequence: Synthetic oligonucleotide

SEQ ID NO: 421274 - DNA, 32 bp, Artificial Sequence; identical to SEQ ID NO: 73152
  Description of Artificial Sequence: Synthetic oligonucleotide

SEQ ID NO: 421275 - DNA, 31 bp, Artificial Sequence; identical to SEQ ID NO: 73153
  Description of Artificial Sequence: Synthetic oligonucleotide

SEQ ID NO: 421276 - DNA, 21 bp, Artificial Sequence
  Description of Artificial Sequence: Synthetic oligonucleotide
gagctggggcggcctgtcgct

SEQ ID NO: 421277 - DNA, 22 bp, Artificial Sequence
  Description of Artificial Sequence: Synthetic oligonucleotide
agctggggcggcctgtcgctga

SEQ ID NO: 421278 - DNA, 21 bp, Artificial Sequence
  Description of Artificial Sequence: Synthetic oligonucleotide
gctggggcggcctgtcgctga

SEQ ID NO: 421279 - DNA, 23 bp, Artificial Sequence
  Description of Artificial Sequence: Synthetic oligonucleotide
ctggggcggcctgtcgctgagta

SEQ ID NO: 421280 - DNA, 24 bp, Artificial Sequence
  Description of Artificial Sequence: Synthetic oligonucleotide
tggggcggcctgtcgctgagtact

SEQ ID NO: 421281 - DNA, 23 bp, Artificial Sequence
  Description of Artificial Sequence: Synthetic oligonucleotide
ggggcggcctgtcgctgagtact

SEQ ID NO: 421282 - DNA, 23 bp, Artificial Sequence
  Description of Artificial Sequence: Synthetic oligonucleotide
gggcggcctgtcgctgagtactg

SEQ ID NO: 421283 - DNA, 25 bp, Artificial Sequence
  Description of Artificial Sequence: Synthetic oligonucleotide
ggcggcctgtcgctgagtactggaa

SEQ ID NO: 421284 - DNA, 26 bp, Artificial Sequence
  Description of Artificial Sequence: Synthetic oligonucleotide
gcggcctgtcgctgagtactggaaca

SEQ ID NO: 421285 - DNA, 26 bp, Artificial Sequence
  Description of Artificial Sequence: Synthetic oligonucleotide
cggcctgtcgctgagtactggaacag

SEQ ID NO: 421286 - DNA, 26 bp, Artificial Sequence
  Description of Artificial Sequence: Synthetic oligonucleotide
ggcctgtcgctgagtactggaacagc

SEQ ID NO: 421287 - DNA, 27 bp, Artificial Sequence
  Description of Artificial Sequence: Synthetic oligonucleotide
gcctgtcgctgagtactggaacagcca

SEQ ID NO: 421288 - DNA, 27 bp, Artificial Sequence
  Description of Artificial Sequence: Synthetic oligonucleotide
cctgtcgctgagtactggaacagccag

SEQ ID NO: 421289 - DNA, 29 bp, Artificial Sequence
  Description of Artificial Sequence: Synthetic oligonucleotide
ctgtcgctgagtactggaacagccagaag

SEQ ID NO: 421290 - DNA, 29 bp, Artificial Sequence
  Description of Artificial Sequence: Synthetic oligonucleotide
tgtcgctgagtactggaacagccagaagg

SEQ ID NO: 421291 - DNA, 28 bp, Artificial Sequence
  Description of Artificial Sequence: Synthetic oligonucleotide
gtcgctgagtactggaacagccagaagg

SEQ ID NO: 421292 - DNA, 29 bp, Artificial Sequence
  Description of Artificial Sequence: Synthetic oligonucleotide
tcgctgagtactggaacagccagaaggac

SEQ ID NO: 421293 - DNA, 21 bp, Artificial Sequence
  Description of Artificial Sequence: Synthetic oligonucleotide
gagctggggcggcctgaggct

SEQ ID NO: 421294 - DNA, 22 bp, Artificial Sequence
  Description of Artificial Sequence: Synthetic oligonucleotide
agctggggcggcctgaggctga

SEQ ID NO: 421295 - DNA, 21 bp, Artificial Sequence
  Description of Artificial Sequence: Synthetic oligonucleotide
gctggggcggcctgaggctga

SEQ ID NO: 421296 - DNA, 23 bp, Artificial Sequence
  Description of Artificial Sequence: Synthetic oligonucleotide
ctggggcggcctgaggctgagta

SEQ ID NO: 421297 - DNA, 24 bp, Artificial Sequence
  Description of Artificial Sequence: Synthetic oligonucleotide
tggggcggcctgaggctgagtact

SEQ ID NO: 421298 - DNA, 23 bp, Artificial Sequence
  Description of Artificial Sequence: Synthetic oligonucleotide
ggggcggcctgaggctgagtact

SEQ ID NO: 421299 - DNA, 23 bp, Artificial Sequence
  Description of Artificial Sequence: Synthetic oligonucleotide
gggcggcctgaggctgagtactg

SEQ ID NO: 421300 - DNA, 25 bp, Artificial Sequence
  Description of Artificial Sequence: Synthetic oligonucleotide
ggcggcctgaggctgagtactggaa

SEQ ID NO: 421301 - DNA, 26 bp, Artificial Sequence
  Description of Artificial Sequence: Synthetic oligonucleotide
gcggcctgaggctgagtactggaaca

SEQ ID NO: 421302 - DNA, 26 bp, Artificial Sequence
  Description of Artificial Sequence: Synthetic oligonucleotide
cggcctgaggctgagtactggaacag

SEQ ID NO: 421303 - DNA, 26 bp, Artificial Sequence
  Description of Artificial Sequence: Synthetic oligonucleotide
ggcctgaggctgagtactggaacagc

SEQ ID NO: 421304 - DNA, 27 bp, Artificial Sequence
  Description of Artificial Sequence: Synthetic oligonucleotide
gcctgaggctgagtactggaacagcca

SEQ ID NO: 421305 - DNA, 27 bp, Artificial Sequence
  Description of Artificial Sequence: Synthetic oligonucleotide
cctgaggctgagtactggaacagccag

SEQ ID NO: 421306 - DNA, 29 bp, Artificial Sequence
  Description of Artificial Sequence: Synthetic oligonucleotide
ctgaggctgagtactggaacagccagaag

SEQ ID NO: 421307 - DNA, 29 bp, Artificial Sequence
  Description of Artificial Sequence: Synthetic oligonucleotide
tgaggctgagtactggaacagccagaagg

SEQ ID NO: 421308 - DNA, 28 bp, Artificial Sequence
  Description of Artificial Sequence: Synthetic oligonucleotide
gaggctgagtactggaacagccagaagg

SEQ ID NO: 421309 - DNA, 29 bp, Artificial Sequence
  Description of Artificial Sequence: Synthetic oligonucleotide
aggctgagtactggaacagccagaaggac

SEQ ID NO: 421310 - DNA, 28 bp, Artificial Sequence
  Description of Artificial Sequence: Synthetic oligonucleotide
ggctgagtactggaacagccagaaggac

SEQ ID NO: 421311 - DNA, 35 bp, Artificial Sequence; identical to SEQ ID NO: 73189
  Description of Artificial Sequence: Synthetic oligonucleotide

SEQ ID NO: 421312 - DNA, 34 bp, Artificial Sequence; identical to SEQ ID NO: 73190
  Description of Artificial Sequence: Synthetic oligonucleotide

SEQ ID NO: 421313 - DNA, 33 bp, Artificial Sequence; identical to SEQ ID NO: 73191
  Description of Artificial Sequence: Synthetic oligonucleotide

SEQ ID NO: 421314 - DNA, 33 bp, Artificial Sequence; identical to SEQ ID NO: 73192
  Description of Artificial Sequence: Synthetic oligonucleotide

SEQ ID NO: 421315 - DNA, 33 bp, Artificial Sequence; identical to SEQ ID NO: 73193
  Description of Artificial Sequence: Synthetic oligonucleotide

SEQ ID NO: 421316 - DNA, 32 bp, Artificial Sequence; identical to SEQ ID NO: 73194
  Description of Artificial Sequence: Synthetic oligonucleotide

SEQ ID NO: 421317 - DNA, 33 bp, Artificial Sequence; identical to SEQ ID NO: 73195
  Description of Artificial Sequence: Synthetic oligonucleotide

SEQ ID NO: 421318 - DNA, 33 bp, Artificial Sequence; identical to SEQ ID NO: 73196
  Description of Artificial Sequence: Synthetic oligonucleotide

SEQ ID NO: 421319 - DNA, 32 bp, Artificial Sequence; identical to SEQ ID NO: 73197
  Description of Artificial Sequence: Synthetic oligonucleotide

SEQ ID NO: 421320 - DNA, 32 bp, Artificial Sequence; identical to SEQ ID NO: 73198
  Description of Artificial Sequence: Synthetic oligonucleotide

SEQ ID NO: 421321 - DNA, 31 bp, Artificial Sequence; identical to SEQ ID NO: 73199
  Description of Artificial Sequence: Synthetic oligonucleotide

SEQ ID NO: 421322 - DNA, 31 bp, Artificial Sequence; identical to SEQ ID NO: 73200
  Description of Artificial Sequence: Synthetic oligonucleotide

SEQ ID NO: 421323 - DNA, 30 bp, Artificial Sequence; identical to SEQ ID NO: 73201
  Description of Artificial Sequence: Synthetic oligonucleotide

SEQ ID NO: 421324 - DNA, 29 bp, Artificial Sequence
  Description of Artificial Sequence: Synthetic oligonucleotide
acttctataaccaggaggagaccgtgcgc

SEQ ID NO: 421325 - DNA, 28 bp, Artificial Sequence
  Description of Artificial Sequence: Synthetic oligonucleotide
cttctataaccaggaggagaccgtgcgc

SEQ ID NO: 421326 - DNA, 30 bp, Artificial Sequence; identical to SEQ ID NO: 73204
  Description of Artificial Sequence: Synthetic oligonucleotide

SEQ ID NO: 421327 - DNA, 29 bp, Artificial Sequence
  Description of Artificial Sequence: Synthetic oligonucleotide
tctataaccaggaggagaccgtgcgcttc

SEQ ID NO: 421328 - DNA, 28 bp, Artificial Sequence
  Description of Artificial Sequence: Synthetic oligonucleotide
ctataaccaggaggagaccgtgcgcttc

SEQ ID NO: 421329 - DNA, 28 bp, Artificial Sequence
  Description of Artificial Sequence: Synthetic oligonucleotide
tataaccaggaggagaccgtgcgcttcg

SEQ ID NO: 421330 - DNA, 27 bp, Artificial Sequence
  Description of Artificial Sequence: Synthetic oligonucleotide
ataaccaggaggagaccgtgcgcttcg

SEQ ID NO: 421331 - DNA, 27 bp, Artificial Sequence
  Description of Artificial Sequence: Synthetic oligonucleotide
taaccaggaggagaccgtgcgcttcga

SEQ ID NO: 421332 - DNA, 26 bp, Artificial Sequence
  Description of Artificial Sequence: Synthetic oligonucleotide
aaccaggaggagaccgtgcgcttcga

SEQ ID NO: 421333 - DNA, 25 bp, Artificial Sequence
  Description of Artificial Sequence: Synthetic oligonucleotide
accaggaggagaccgtgcgcttcga

SEQ ID NO: 421334 - DNA, 24 bp, Artificial Sequence
  Description of Artificial Sequence: Synthetic oligonucleotide
ccaggaggagaccgtgcgcttcga

SEQ ID NO: 421335 - DNA, 25 bp, Artificial Sequence
  Description of Artificial Sequence: Synthetic oligonucleotide
caggaggagaccgtgcgcttcgaca

SEQ ID NO: 421336 - DNA, 25 bp, Artificial Sequence
  Description of Artificial Sequence: Synthetic oligonucleotide
aggaggagaccgtgcgcttcgacag

SEQ ID NO: 421337 - DNA, 24 bp, Artificial Sequence
  Description of Artificial Sequence: Synthetic oligonucleotide
ggaggagaccgtgcgcttcgacag

SEQ ID NO: 421338 - DNA, 24 bp, Artificial Sequence
  Description of Artificial Sequence: Synthetic oligonucleotide
gaggagaccgtgcgcttcgacagc

SEQ ID NO: 421339 - DNA, 25 bp, Artificial Sequence
  Description of Artificial Sequence: Synthetic oligonucleotide
aggagaccgtgcgcttcgacagcga

SEQ ID NO: 421340 - DNA, 24 bp, Artificial Sequence
  Description of Artificial Sequence: Synthetic oligonucleotide
ggagaccgtgcgcttcgacagcga

SEQ ID NO: 421341 - DNA, 24 bp, Artificial Sequence
  Description of Artificial Sequence: Synthetic oligonucleotide
gagaccgtgcgcttcgacagcgac

SEQ ID NO: 421342 - DNA, 25 bp, Artificial Sequence
  Description of Artificial Sequence: Synthetic oligonucleotide
agaccgtgcgcttcgacagcgacgt

SEQ ID NO: 421343 - DNA, 24 bp, Artificial Sequence
  Description of Artificial Sequence: Synthetic oligonucleotide
gaccgtgcgcttcgacagcgacgt

SEQ ID NO: 421344 - DNA, 24 bp, Artificial Sequence
  Description of Artificial Sequence: Synthetic oligonucleotide
accgtgcgcttcgacagcgacgtg

SEQ ID NO: 421345 - DNA, 28 bp, Artificial Sequence
  Description of Artificial Sequence: Synthetic oligonucleotide
gtttcctgtggcagcctaagagggagag

SEQ ID NO: 421346 - DNA, 29 bp, Artificial Sequence
  Description of Artificial Sequence: Synthetic oligonucleotide
tttcctgtggcagcctaagagggagagtc

SEQ ID NO: 421347 - DNA, 28 bp, Artificial Sequence
  Description of Artificial Sequence: Synthetic oligonucleotide
ttcctgtggcagcctaagagggagagtc

SEQ ID NO: 421348 - DNA, 27 bp, Artificial Sequence
  Description of Artificial Sequence: Synthetic oligonucleotide
tcctgtggcagcctaagagggagagtc

SEQ ID NO: 421349 - DNA, 27 bp, Artificial Sequence
  Description of Artificial Sequence: Synthetic oligonucleotide
cctgtggcagcctaagagggagagtca

SEQ ID NO: 421350 - DNA, 30 bp, Artificial Sequence; identical to SEQ ID NO: 73228
  Description of Artificial Sequence: Synthetic oligonucleotide

SEQ ID NO: 421351 - DNA, 32 bp, Artificial Sequence; identical to SEQ ID NO: 73229
  Description of Artificial Sequence: Synthetic oligonucleotide

SEQ ID NO: 421352 - DNA, 31 bp, Artificial Sequence; identical to SEQ ID NO: 73230
  Description of Artificial Sequence: Synthetic oligonucleotide

SEQ ID NO: 421353 - DNA, 34 bp, Artificial Sequence; identical to SEQ ID NO: 73231
  Description of Artificial Sequence: Synthetic oligonucleotide

SEQ ID NO: 421354 - DNA, 33 bp, Artificial Sequence; identical to SEQ ID NO: 73232
  Description of Artificial Sequence: Synthetic oligonucleotide

SEQ ID NO: 421355 - DNA, 33 bp, Artificial Sequence; identical to SEQ ID NO: 73233
  Description of Artificial Sequence: Synthetic oligonucleotide

SEQ ID NO: 421356 - DNA, 33 bp, Artificial Sequence; identical to SEQ ID NO: 73234
  Description of Artificial Sequence: Synthetic oligonucleotide

SEQ ID NO: 421357 - DNA, 34 bp, Artificial Sequence; identical to SEQ ID NO: 73235
  Description of Artificial Sequence: Synthetic oligonucleotide

SEQ ID NO: 421358 - DNA, 33 bp, Artificial Sequence; identical to SEQ ID NO: 73236
  Description of Artificial Sequence: Synthetic oligonucleotide

SEQ ID NO: 421359 - DNA, 33 bp, Artificial Sequence; identical to SEQ ID NO: 73237
  Description of Artificial Sequence: Synthetic oligonucleotide

SEQ ID NO: 421360 - DNA, 33 bp, Artificial Sequence; identical to SEQ ID NO: 73238
  Description of Artificial Sequence: Synthetic oligonucleotide

SEQ ID NO: 421361 - DNA, 34 bp, Artificial Sequence; identical to SEQ ID NO: 73239
  Description of Artificial Sequence: Synthetic oligonucleotide

SEQ ID NO: 421362 - DNA, 33 bp, Artificial Sequence; identical to SEQ ID NO: 73240
  Description of Artificial Sequence: Synthetic oligonucleotide

SEQ ID NO: 421363 - DNA, 32 bp, Artificial Sequence; identical to SEQ ID NO: 73241
  Description of Artificial Sequence: Synthetic oligonucleotide

SEQ ID NO: 421364 - DNA, 31 bp, Artificial Sequence; identical to SEQ ID NO: 73242
  Description of Artificial Sequence: Synthetic oligonucleotide

SEQ ID NO: 421365 - DNA, 31 bp, Artificial Sequence; identical to SEQ ID NO: 73243
  Description of Artificial Sequence: Synthetic oligonucleotide

SEQ ID NO: 421366 - DNA, 30 bp, Artificial Sequence; identical to SEQ ID NO: 73244
  Description of Artificial Sequence: Synthetic oligonucleotide

SEQ ID NO: 421367 - DNA, 30 bp, Artificial Sequence; identical to SEQ ID NO: 73245
  Description of Artificial Sequence: Synthetic oligonucleotide

SEQ ID NO: 421368 - DNA, 30 bp, Artificial Sequence; identical to SEQ ID NO: 73246
  Description of Artificial Sequence: Synthetic oligonucleotide

SEQ ID NO: 421369 - DNA, 30 bp, Artificial Sequence; identical to SEQ ID NO: 73247
  Description of Artificial Sequence: Synthetic oligonucleotide

SEQ ID NO: 421370 - DNA, 29 bp, Artificial Sequence
  Description of Artificial Sequence: Synthetic oligonucleotide
gagtcatttcttcaatgggacggagcggg

SEQ ID NO: 421371 - DNA, 30 bp, Artificial Sequence; identical to SEQ ID NO: 73249
  Description of Artificial Sequence: Synthetic oligonucleotide

SEQ ID NO: 421372 - DNA, 24 bp, Artificial Sequence
  Description of Artificial Sequence: Synthetic oligonucleotide
ccgcggtggacacctactgcagac

SEQ ID NO: 421373 - DNA, 24 bp, Artificial Sequence
  Description of Artificial Sequence: Synthetic oligonucleotide
cgcggtggacacctactgcagacg

SEQ ID NO: 421374 - DNA, 26 bp, Artificial Sequence
  Description of Artificial Sequence: Synthetic oligonucleotide
gcggtggacacctactgcagacgcaa

SEQ ID NO: 421375 - DNA, 27 bp, Artificial Sequence
  Description of Artificial Sequence: Synthetic oligonucleotide
cggtggacacctactgcagacgcaact

SEQ ID NO: 421376 - DNA, 28 bp, Artificial Sequence
  Description of Artificial Sequence: Synthetic oligonucleotide
ggtggacacctactgcagacgcaactac

SEQ ID NO: 421377 - DNA, 28 bp, Artificial Sequence
  Description of Artificial Sequence: Synthetic oligonucleotide
gtggacacctactgcagacgcaactacg

SEQ ID NO: 421378 - DNA, 28 bp, Artificial Sequence
  Description of Artificial Sequence: Synthetic oligonucleotide
tggacacctactgcagacgcaactacgg

SEQ ID NO: 421379 - DNA, 27 bp, Artificial Sequence
  Description of Artificial Sequence: Synthetic oligonucleotide
ggacacctactgcagacgcaactacgg

SEQ ID NO: 421380 - DNA, 27 bp, Artificial Sequence
  Description of Artificial Sequence: Synthetic oligonucleotide
gacacctactgcagacgcaactacggg

SEQ ID NO: 421381 - DNA, 27 bp, Artificial Sequence
  Description of Artificial Sequence: Synthetic oligonucleotide
acacctactgcagacgcaactacgggg

SEQ ID NO: 421382 - DNA, 27 bp, Artificial Sequence
  Description of Artificial Sequence: Synthetic oligonucleotide
cacctactgcagacgcaactacggggt

SEQ ID NO: 421383 - DNA, 28 bp, Artificial Sequence
  Description of Artificial Sequence: Synthetic oligonucleotide
acctactgcagacgcaactacggggttg

SEQ ID NO: 421384 - DNA, 27 bp, Artificial Sequence
  Description of Artificial Sequence: Synthetic oligonucleotide
cctactgcagacgcaactacggggttg

SEQ ID NO: 421385 - DNA, 28 bp, Artificial Sequence
  Description of Artificial Sequence: Synthetic oligonucleotide
ctactgcagacgcaactacggggttgtg

SEQ ID NO: 421386 - DNA, 28 bp, Artificial Sequence
  Description of Artificial Sequence: Synthetic oligonucleotide
tactgcagacgcaactacggggttgtgg

SEQ ID NO: 421387 - DNA, 27 bp, Artificial Sequence
  Description of Artificial Sequence: Synthetic oligonucleotide
actgcagacgcaactacggggttgtgg

SEQ ID NO: 421388 - DNA, 27 bp, Artificial Sequence
  Description of Artificial Sequence: Synthetic oligonucleotide
ctgcagacgcaactacggggttgtgga

SEQ ID NO: 421389 - DNA, 27 bp, Artificial Sequence
  Description of Artificial Sequence: Synthetic oligonucleotide
tgcagacgcaactacggggttgtggag

SEQ ID NO: 421390 - DNA, 27 bp, Artificial Sequence
  Description of Artificial Sequence: Synthetic oligonucleotide
gcagacgcaactacggggttgtggaga

SEQ ID NO: 421391 - DNA, 27 bp, Artificial Sequence
  Description of Artificial Sequence: Synthetic oligonucleotide
cagacgcaactacggggttgtggagag

SEQ ID NO: 421392 - DNA, 27 bp, Artificial Sequence
  Description of Artificial Sequence: Synthetic oligonucleotide
agacgcaactacggggttgtggagagc

SEQ ID NO: 421393 - DNA, 27 bp, Artificial Sequence
  Description of Artificial Sequence: Synthetic oligonucleotide
gacgcaactacggggttgtggagagct

SEQ ID NO: 421394 - DNA, 28 bp, Artificial Sequence
  Description of Artificial Sequence: Synthetic oligonucleotide
acgcaactacggggttgtggagagcttc

SEQ ID NO: 421395 - DNA, 27 bp, Artificial Sequence
  Description of Artificial Sequence: Synthetic oligonucleotide
cgcaactacggggttgtggagagcttc

SEQ ID NO: 421396 - DNA, 28 bp, Artificial Sequence
  Description of Artificial Sequence: Synthetic oligonucleotide
gcaactacggggttgtggagagcttcac

SEQ ID NO: 421397 - DNA, 20 bp, Artificial Sequence
  Description of Artificial Sequence: Synthetic oligonucleotide
gcgcgggccgcggtggacaa

SEQ ID NO: 421398 - DNA, 22 bp, Artificial Sequence
  Description of Artificial Sequence: Synthetic oligonucleotide
cgcgggccgcggtggacaacta

SEQ ID NO: 421399 - DNA, 22 bp, Artificial Sequence
  Description of Artificial Sequence: Synthetic oligonucleotide
acggagctggggcggcctgaca

SEQ ID NO: 421400 - DNA, 21 bp, Artificial Sequence
  Description of Artificial Sequence: Synthetic oligonucleotide
cggagctggggcggcctgaca

SEQ ID NO: 421401 - DNA, 22 bp, Artificial Sequence
  Description of Artificial Sequence: Synthetic oligonucleotide
ggagctggggcggcctgacact

SEQ ID NO: 421402 - DNA, 23 bp, Artificial Sequence
  Description of Artificial Sequence: Synthetic oligonucleotide
gagctggggcggcctgacactga

SEQ ID NO: 421403 - DNA, 25 bp, Artificial Sequence
  Description of Artificial Sequence: Synthetic oligonucleotide
agctggggcggcctgacactgagta

SEQ ID NO: 421404 - DNA, 24 bp, Artificial Sequence
  Description of Artificial Sequence: Synthetic oligonucleotide
gctggggcggcctgacactgagta

SEQ ID NO: 421405 - DNA, 25 bp, Artificial Sequence
  Description of Artificial Sequence: Synthetic oligonucleotide
ctggggcggcctgacactgagtact

SEQ ID NO: 421406 - DNA, 25 bp, Artificial Sequence
  Description of Artificial Sequence: Synthetic oligonucleotide
tggggcggcctgacactgagtactg

SEQ ID NO: 421407 - DNA, 24 bp, Artificial Sequence
  Description of Artificial Sequence: Synthetic oligonucleotide
ggggcggcctgacactgagtactg

SEQ ID NO: 421408 - DNA, 26 bp, Artificial Sequence
  Description of Artificial Sequence: Synthetic oligonucleotide
gggcggcctgacactgagtactggaa

SEQ ID NO: 421409 - DNA, 27 bp, Artificial Sequence
  Description of Artificial Sequence: Synthetic oligonucleotide
ggcggcctgacactgagtactggaaca

SEQ ID NO: 421410 - DNA, 27 bp, Artificial Sequence
  Description of Artificial Sequence: Synthetic oligonucleotide
gcggcctgacactgagtactggaacag

SEQ ID NO: 421411 - DNA, 27 bp, Artificial Sequence
  Description of Artificial Sequence: Synthetic oligonucleotide
cggcctgacactgagtactggaacagc

SEQ ID NO: 421412 - DNA, 27 bp, Artificial Sequence
  Description of Artificial Sequence: Synthetic oligonucleotide
ggcctgacactgagtactggaacagcc

SEQ ID NO: 421413 - DNA, 28 bp, Artificial Sequence
  Description of Artificial Sequence: Synthetic oligonucleotide
gcctgacactgagtactggaacagccag

SEQ ID NO: 421414 - DNA, 30 bp, Artificial Sequence; identical to SEQ ID NO: 73292
  Description of Artificial Sequence: Synthetic oligonucleotide

SEQ ID NO: 421415 - DNA, 30 bp, Artificial Sequence; identical to SEQ ID NO: 73293
  Description of Artificial Sequence: Synthetic oligonucleotide

SEQ ID NO: 421416 - DNA, 31 bp, Artificial Sequence; identical to SEQ ID NO: 73294
  Description of Artificial Sequence: Synthetic oligonucleotide

SEQ ID NO: 421417 - DNA, 30 bp, Artificial Sequence; identical to SEQ ID NO: 73295
  Description of Artificial Sequence: Synthetic oligonucleotide

SEQ ID NO: 421418 - DNA, 32 bp, Artificial Sequence; identical to SEQ ID NO: 73296
  Description of Artificial Sequence: Synthetic oligonucleotide

SEQ ID NO: 421419 - DNA, 31 bp, Artificial Sequence; identical to SEQ ID NO: 73297
  Description of Artificial Sequence: Synthetic oligonucleotide

SEQ ID NO: 421420 - DNA, 31 bp, Artificial Sequence; identical to SEQ ID NO: 73298
  Description of Artificial Sequence: Synthetic oligonucleotide

SEQ ID NO: 421421 - DNA, 30 bp, Artificial Sequence; identical to SEQ ID NO: 73299
  Description of Artificial Sequence: Synthetic oligonucleotide

SEQ ID NO: 421422 - DNA, 34 bp, Artificial Sequence; identical to SEQ ID NO: 73300
  Description of Artificial Sequence: Synthetic oligonucleotide

SEQ ID NO: 421423 - DNA, 33 bp, Artificial Sequence; identical to SEQ ID NO: 73301
  Description of Artificial Sequence: Synthetic oligonucleotide

SEQ ID NO: 421424 - DNA, 32 bp, Artificial Sequence; identical to SEQ ID NO: 73302
  Description of Artificial Sequence: Synthetic oligonucleotide

SEQ ID NO: 421425 - DNA, 31 bp, Artificial Sequence; identical to SEQ ID NO: 73303
  Description of Artificial Sequence: Synthetic oligonucleotide

SEQ ID NO: 421426 - DNA, 33 bp, Artificial Sequence; identical to SEQ ID NO: 73304
  Description of Artificial Sequence: Synthetic oligonucleotide

SEQ ID NO: 421427 - DNA, 36 bp, Artificial Sequence; identical to SEQ ID NO: 73305
  Description of Artificial Sequence: Synthetic oligonucleotide

SEQ ID NO: 421428 - DNA, 35 bp, Artificial Sequence; identical to SEQ ID NO: 73306
  Description of Artificial Sequence: Synthetic oligonucleotide

SEQ ID NO: 421429 - DNA, 35 bp, Artificial Sequence; identical to SEQ ID NO: 73307
  Description of Artificial Sequence: Synthetic oligonucleotide

SEQ ID NO: 421430 - DNA, 34 bp, Artificial Sequence; identical to SEQ ID NO: 73308
  Description of Artificial Sequence: Synthetic oligonucleotide

SEQ ID NO: 421431 - DNA, 34 bp, Artificial Sequence; identical to SEQ ID NO: 73309
  Description of Artificial Sequence: Synthetic oligonucleotide

SEQ ID NO: 421432 - DNA, 35 bp, Artificial Sequence; identical to SEQ ID NO: 73310
  Description of Artificial Sequence: Synthetic oligonucleotide

SEQ ID NO: 421433 - DNA, 35 bp, Artificial Sequence; identical to SEQ ID NO: 73311
  Description of Artificial Sequence: Synthetic oligonucleotide

SEQ ID NO: 421434 - DNA, 34 bp, Artificial Sequence; identical to SEQ ID NO: 73312
  Description of Artificial Sequence: Synthetic oligonucleotide

SEQ ID NO: 421435 - DNA, 34 bp, Artificial Sequence; identical to SEQ ID NO: 73313
  Description of Artificial Sequence: Synthetic oligonucleotide

SEQ ID NO: 421436 - DNA, 35 bp, Artificial Sequence; identical to SEQ ID NO: 73314
  Description of Artificial Sequence: Synthetic oligonucleotide

SEQ ID NO: 421437 - DNA, 35 bp, Artificial Sequence; identical to SEQ ID NO: 73315
  Description of Artificial Sequence: Synthetic oligonucleotide

SEQ ID NO: 421438 - DNA, 34 bp, Artificial Sequence; identical to SEQ ID NO: 73316
  Description of Artificial Sequence: Synthetic oligonucleotide

SEQ ID NO: 421439 - DNA, 33 bp, Artificial Sequence; identical to SEQ ID NO: 73317
  Description of Artificial Sequence: Synthetic oligonucleotide

SEQ ID NO: 421440 - DNA, 32 bp, Artificial Sequence; identical to SEQ ID NO: 73318
  Description of Artificial Sequence: Synthetic oligonucleotide

SEQ ID NO: 421441 - DNA, 32 bp, Artificial Sequence; identical to SEQ ID NO: 73319
  Description of Artificial Sequence: Synthetic oligonucleotide

SEQ ID NO: 421442 - DNA, 31 bp, Artificial Sequence; identical to SEQ ID NO: 73320
  Description of Artificial Sequence: Synthetic oligonucleotide

SEQ ID NO: 421443 - DNA, 31 bp, Artificial Sequence; identical to SEQ ID NO: 73321
  Description of Artificial Sequence: Synthetic oligonucleotide

SEQ ID NO: 421444 - DNA, 31 bp, Artificial Sequence; identical to SEQ ID NO: 73322
  Description of Artificial Sequence: Synthetic oligonucleotide

SEQ ID NO: 421445 - DNA, 32 bp, Artificial Sequence; identical to SEQ ID NO: 73323
  Description of Artificial Sequence: Synthetic oligonucleotide

SEQ ID NO: 421446 - DNA, 31 bp, Artificial Sequence; identical to SEQ ID NO: 73324
  Description of Artificial Sequence: Synthetic oligonucleotide

SEQ ID NO: 421447 - DNA, 31 bp, Artificial Sequence; identical to SEQ ID NO: 73325
  Description of Artificial Sequence: Synthetic oligonucleotide

SEQ ID NO: 421448 - DNA, 30 bp, Artificial Sequence; identical to SEQ ID NO: 73326
  Description of Artificial Sequence: Synthetic oligonucleotide

SEQ ID NO: 421449 - DNA, 26 bp, Artificial Sequence
  Description of Artificial Sequence: Synthetic oligonucleotide
gcggcctgacgctgagtactggaaga

SEQ ID NO: 421450 - DNA, 26 bp, Artificial Sequence
  Description of Artificial Sequence: Synthetic oligonucleotide
cggcctgacgctgagtactggaagag

SEQ ID NO: 421451 - DNA, 26 bp, Artificial Sequence
  Description of Artificial Sequence: Synthetic oligonucleotide
ggcctgacgctgagtactggaagagc

SEQ ID NO: 421452 - DNA, 27 bp, Artificial Sequence
  Description of Artificial Sequence: Synthetic oligonucleotide
gcctgacgctgagtactggaagagcca

SEQ ID NO: 421453 - DNA, 27 bp, Artificial Sequence
  Description of Artificial Sequence: Synthetic oligonucleotide
cctgacgctgagtactggaagagccag

SEQ ID NO: 421454 - DNA, 29 bp, Artificial Sequence
  Description of Artificial Sequence: Synthetic oligonucleotide
ctgacgctgagtactggaagagccagaag

SEQ ID NO: 421455 - DNA, 29 bp, Artificial Sequence
  Description of Artificial Sequence: Synthetic oligonucleotide
tgacgctgagtactggaagagccagaagg

SEQ ID NO: 421456 - DNA, 28 bp, Artificial Sequence
  Description of Artificial Sequence: Synthetic oligonucleotide
gacgctgagtactggaagagccagaagg

SEQ ID NO: 421457 - DNA, 29 bp, Artificial Sequence
  Description of Artificial Sequence: Synthetic oligonucleotide
acgctgagtactggaagagccagaaggac

SEQ ID NO: 421458 - DNA, 28 bp, Artificial Sequence
  Description of Artificial Sequence: Synthetic oligonucleotide
cgctgagtactggaagagccagaaggac

SEQ ID NO: 421459 - DNA, 30 bp, Artificial Sequence; identical to SEQ ID NO: 73337
  Description of Artificial Sequence: Synthetic oligonucleotide

SEQ ID NO: 421460 - DNA, 30 bp, Artificial Sequence; identical to SEQ ID NO: 73338
  Description of Artificial Sequence: Synthetic oligonucleotide

SEQ ID NO: 421461 - DNA, 31 bp, Artificial Sequence; identical to SEQ ID NO: 73339
  Description of Artificial Sequence: Synthetic oligonucleotide

SEQ ID NO: 421462 - DNA, 30 bp, Artificial Sequence; identical to SEQ ID NO: 73340
  Description of Artificial Sequence: Synthetic oligonucleotide

SEQ ID NO: 421463 - DNA, 30 bp, Artificial Sequence; identical to SEQ ID NO: 73341
  Description of Artificial Sequence: Synthetic oligonucleotide

SEQ ID NO: 421464 - DNA, 29 bp, Artificial Sequence
  Description of Artificial Sequence: Synthetic oligonucleotide
gtactggaagagccagaaggacatcctgg

SEQ ID NO: 421465 - DNA, 30 bp, Artificial Sequence; identical to SEQ ID NO: 73343
  Description of Artificial Sequence: Synthetic oligonucleotide

SEQ ID NO: 421466 - DNA, 29 bp, Artificial Sequence
  Description of Artificial Sequence: Synthetic oligonucleotide
actggaagagccagaaggacatcctggag

SEQ ID NO: 421467 - DNA, 28 bp, Artificial Sequence
  Description of Artificial Sequence: Synthetic oligonucleotide
ctggaagagccagaaggacatcctggag

SEQ ID NO: 421468 - DNA, 28 bp, Artificial Sequence
  Description of Artificial Sequence: Synthetic oligonucleotide
tggaagagccagaaggacatcctggagc

SEQ ID NO: 421469 - DNA, 27 bp, Artificial Sequence
  Description of Artificial Sequence: Synthetic oligonucleotide
ggaagagccagaaggacatcctggagc

SEQ ID NO: 421470 - DNA, 28 bp, Artificial Sequence
  Description of Artificial Sequence: Synthetic oligonucleotide
gaagagccagaaggacatcctggagcag

SEQ ID NO: 421471 - DNA, 28 bp, Artificial Sequence
  Description of Artificial Sequence: Synthetic oligonucleotide
aagagccagaaggacatcctggagcagg

SEQ ID NO: 421472 - DNA, 27 bp, Artificial Sequence
  Description of Artificial Sequence: Synthetic oligonucleotide
agagccagaaggacatcctggagcagg

SEQ ID NO: 421473 - DNA, 26 bp, Artificial Sequence
  Description of Artificial Sequence: Synthetic oligonucleotide
gagccagaaggacatcctggagcagg

SEQ ID NO: 421474 - DNA, 31 bp, Artificial Sequence; identical to SEQ ID NO: 73352
  Description of Artificial Sequence: Synthetic oligonucleotide

SEQ ID NO: 421475 - DNA, 32 bp, Artificial Sequence; identical to SEQ ID NO: 73382
  Description of Artificial Sequence: Synthetic oligonucleotide

SEQ ID NO: 421476 - DNA, 31 bp, Artificial Sequence; identical to SEQ ID NO: 73383
  Description of Artificial Sequence: Synthetic oligonucleotide

SEQ ID NO: 421477 - DNA, 32 bp, Artificial Sequence; identical to SEQ ID NO: 73384
  Description of Artificial Sequence: Synthetic oligonucleotide

SEQ ID NO: 421478 - DNA, 32 bp, Artificial Sequence; identical to SEQ ID NO: 73385
  Description of Artificial Sequence: Synthetic oligonucleotide

SEQ ID NO: 421479 - DNA, 32 bp, Artificial Sequence; identical to SEQ ID NO: 73386
  Description of Artificial Sequence: Synthetic oligonucleotide

SEQ ID NO: 421480 - DNA, 31 bp, Artificial Sequence; identical to SEQ ID NO: 73387
  Description of Artificial Sequence: Synthetic oligonucleotide

SEQ ID NO: 421481 - DNA, 32 bp, Artificial Sequence; identical to SEQ ID NO: 73388
  Description of Artificial Sequence: Synthetic oligonucleotide

SEQ ID NO: 421482 - DNA, 32 bp, Artificial Sequence; identical to SEQ ID NO: 73389
  Description of Artificial Sequence: Synthetic oligonucleotide

SEQ ID NO: 421483 - DNA, 32 bp, Artificial Sequence; identical to SEQ ID NO: 73390
  Description of Artificial Sequence: Synthetic oligonucleotide

SEQ ID NO: 421484 - DNA, 31 bp, Artificial Sequence; identical to SEQ ID NO: 73391
  Description of Artificial Sequence: Synthetic oligonucleotide

SEQ ID NO: 421485 - DNA, 30 bp, Artificial Sequence; identical to SEQ ID NO: 73392
  Description of Artificial Sequence: Synthetic oligonucleotide

SEQ ID NO: 421486 - DNA, 29 bp, Artificial Sequence
  Description of Artificial Sequence: Synthetic oligonucleotide
gagggagtgtcatttcttcagtgggacgg

SEQ ID NO: 421487 - DNA, 30 bp, Artificial Sequence; identical to SEQ ID NO: 73394
  Description of Artificial Sequence: Synthetic oligonucleotide

SEQ ID NO: 421488 - DNA, 29 bp, Artificial Sequence
  Description of Artificial Sequence: Synthetic oligonucleotide
gggagtgtcatttcttcagtgggacggag

SEQ ID NO: 421489 - DNA, 29 bp, Artificial Sequence
  Description of Artificial Sequence: Synthetic oligonucleotide
ggagtgtcatttcttcagtgggacggagc

SEQ ID NO: 421490 - DNA, 23 bp, Artificial Sequence
  Description of Artificial Sequence: Synthetic oligonucleotide
gacatcctggagcaggcgcgggt

SEQ ID NO: 421491 - DNA, 23 bp, Artificial Sequence
  Description of Artificial Sequence: Synthetic oligonucleotide
acatcctggagcaggcgcgggtc

SEQ ID NO: 421492 - DNA, 22 bp, Artificial Sequence
  Description of Artificial Sequence: Synthetic oligonucleotide
catcctggagcaggcgcgggtc

SEQ ID NO: 421493 - DNA, 22 bp, Artificial Sequence
  Description of Artificial Sequence: Synthetic oligonucleotide
atcctggagcaggcgcgggtcg

SEQ ID NO: 421494 - DNA, 21 bp, Artificial Sequence
  Description of Artificial Sequence: Synthetic oligonucleotide
tcctggagcaggcgcgggtcg

SEQ ID NO: 421495 - DNA, 20 bp, Artificial Sequence
  Description of Artificial Sequence: Synthetic oligonucleotide
cctggagcaggcgcgggtcg

SEQ ID NO: 421496 - DNA, 20 bp, Artificial Sequence
  Description of Artificial Sequence: Synthetic oligonucleotide
ctggagcaggcgcgggtcgc

SEQ ID NO: 421497 - DNA, 20 bp, Artificial Sequence
  Description of Artificial Sequence: Synthetic oligonucleotide
tggagcaggcgcgggtcgcg

SEQ ID NO: 421498 - DNA, 20 bp, Artificial Sequence
  Description of Artificial Sequence: Synthetic oligonucleotide
ggagcaggcgcgggtcgcgt

SEQ ID NO: 421499 - DNA, 20 bp, Artificial Sequence
  Description of Artificial Sequence: Synthetic oligonucleotide
gagcaggcgcgggtcgcggt

SEQ ID NO: 421500 - DNA, 20 bp, Artificial Sequence
  Description of Artificial Sequence: Synthetic oligonucleotide
agcaggcgcgggtcgcggtg

SEQ ID NO: 421501 - DNA, 20 bp, Artificial Sequence
  Description of Artificial Sequence: Synthetic oligonucleotide
gcaggcgcgggtcgcggtgt

SEQ ID NO: 421502 - DNA, 20 bp, Artificial Sequence
  Description of Artificial Sequence: Synthetic oligonucleotide
caggcgcgggtcgcggtgga

SEQ ID NO: 421503 - DNA, 21 bp, Artificial Sequence
  Description of Artificial Sequence: Synthetic oligonucleotide
aggcgcgggtcgcggtggaca

SEQ ID NO: 421504 - DNA, 20 bp, Artificial Sequence
  Description of Artificial Sequence: Synthetic oligonucleotide
ggcgcgggtcgcggtggaca

SEQ ID NO: 421505 - DNA, 20 bp, Artificial Sequence
  Description of Artificial Sequence: Synthetic oligonucleotide
gcgcgggtcgcggtggacac

SEQ ID NO: 421506 - DNA, 22 bp, Artificial Sequence
  Description of Artificial Sequence: Synthetic oligonucleotide
cgcgggtcgcggtggacaccta

SEQ ID NO: 421507 - DNA, 23 bp, Artificial Sequence
  Description of Artificial Sequence: Synthetic oligonucleotide
gcgggtcgcggtggacacctact

SEQ ID NO: 421508 - DNA, 23 bp, Artificial Sequence
  Description of Artificial Sequence: Synthetic oligonucleotide
cgggtcgcggtggacacctactg

SEQ ID NO: 421509 - DNA, 24 bp, Artificial Sequence
  Description of Artificial Sequence: Synthetic oligonucleotide
gggtcgcggtggacacctactgca

SEQ ID NO: 421510 - DNA, 25 bp, Artificial Sequence
  Description of Artificial Sequence: Synthetic oligonucleotide
ggtcgcggtggacacctactgcaga

SEQ ID NO: 421511 - DNA, 26 bp, Artificial Sequence
  Description of Artificial Sequence: Synthetic oligonucleotide
gtcgcggtggacacctactgcagaca

SEQ ID NO: 421512 - DNA, 27 bp, Artificial Sequence
  Description of Artificial Sequence: Synthetic oligonucleotide
tcgcggtggacacctactgcagacaca

SEQ ID NO: 421513 - DNA, 21 bp, Artificial Sequence
  Description of Artificial Sequence: Synthetic oligonucleotide
gggcggtgacggagctggggt

SEQ ID NO: 421514 - DNA, 21 bp, Artificial Sequence
  Description of Artificial Sequence: Synthetic oligonucleotide
ggcggtgacggagctggggtg

SEQ ID NO: 421515 - DNA, 21 bp, Artificial Sequence
  Description of Artificial Sequence: Synthetic oligonucleotide
gcggtgacggagctggggtgg

SEQ ID NO: 421516 - DNA, 21 bp, Artificial Sequence
  Description of Artificial Sequence: Synthetic oligonucleotide
cggtgacggagctggggtggc

SEQ ID NO: 421517 - DNA, 22 bp, Artificial Sequence
  Description of Artificial Sequence: Synthetic oligonucleotide
ggtgacggagctggggtggcct

SEQ ID NO: 421518 - DNA, 23 bp, Artificial Sequence
  Description of Artificial Sequence: Synthetic oligonucleotide
gtgacggagctggggtggcctga

SEQ ID NO: 421519 - DNA, 23 bp, Artificial Sequence
  Description of Artificial Sequence: Synthetic oligonucleotide
tgacggagctggggtggcctgac

SEQ ID NO: 421520 - DNA, 22 bp, Artificial Sequence
  Description of Artificial Sequence: Synthetic oligonucleotide
gacggagctggggtggcctgac

SEQ ID NO: 421521 - DNA, 22 bp, Artificial Sequence
  Description of Artificial Sequence: Synthetic oligonucleotide
acggagctggggtggcctgacg

SEQ ID NO: 421522 - DNA, 21 bp, Artificial Sequence
  Description of Artificial Sequence: Synthetic oligonucleotide
cggagctggggtggcctgacg

SEQ ID NO: 421523 - DNA, 21 bp, Artificial Sequence
  Description of Artificial Sequence: Synthetic oligonucleotide
ggagctggggtggcctgacgc

SEQ ID NO: 421524 - DNA, 21 bp, Artificial Sequence
  Description of Artificial Sequence: Synthetic oligonucleotide
gagctggggtggcctgacgcc

SEQ ID NO: 421525 - DNA, 22 bp, Artificial Sequence
  Description of Artificial Sequence: Synthetic oligonucleotide
agctggggtggcctgacgccga

SEQ ID NO: 421526 - DNA, 21 bp, Artificial Sequence
  Description of Artificial Sequence: Synthetic oligonucleotide
gctggggtggcctgacgccga

SEQ ID NO: 421527 - DNA, 23 bp, Artificial Sequence
  Description of Artificial Sequence: Synthetic oligonucleotide
ctggggtggcctgacgccgagta

SEQ ID NO: 421528 - DNA, 24 bp, Artificial Sequence
  Description of Artificial Sequence: Synthetic oligonucleotide
tggggtggcctgacgccgagtact

SEQ ID NO: 421529 - DNA, 23 bp, Artificial Sequence
  Description of Artificial Sequence: Synthetic oligonucleotide
ggggtggcctgacgccgagtact

SEQ ID NO: 421530 - DNA, 23 bp, Artificial Sequence
  Description of Artificial Sequence: Synthetic oligonucleotide
gggtggcctgacgccgagtactg

SEQ ID NO: 421531 - DNA, 25 bp, Artificial Sequence
  Description of Artificial Sequence: Synthetic oligonucleotide
ggtggcctgacgccgagtactggaa

SEQ ID NO: 421532 - DNA, 26 bp, Artificial Sequence
  Description of Artificial Sequence: Synthetic oligonucleotide
gtggcctgacgccgagtactggaaca

SEQ ID NO: 421533 - DNA, 26 bp, Artificial Sequence
  Description of Artificial Sequence: Synthetic oligonucleotide
tggcctgacgccgagtactggaacag

SEQ ID NO: 421534 - DNA, 25 bp, Artificial Sequence
  Description of Artificial Sequence: Synthetic oligonucleotide
cagaaggacatcctggagcaggcgg

SEQ ID NO: 421535 - DNA, 25 bp, Artificial Sequence
  Description of Artificial Sequence: Synthetic oligonucleotide
agaaggacatcctggagcaggcggg

SEQ ID NO: 421536 - DNA, 24 bp, Artificial Sequence
  Description of Artificial Sequence: Synthetic oligonucleotide
gaaggacatcctggagcaggcggg

SEQ ID NO: 421537 - DNA, 24 bp, Artificial Sequence
  Description of Artificial Sequence: Synthetic oligonucleotide
aaggacatcctggagcaggcgggg

SEQ ID NO: 421538 - DNA, 23 bp, Artificial Sequence
  Description of Artificial Sequence: Synthetic oligonucleotide
aggacatcctggagcaggcgggg

SEQ ID NO: 421539 - DNA, 22 bp, Artificial Sequence
  Description of Artificial Sequence: Synthetic oligonucleotide
ggacatcctggagcaggcgggg

SEQ ID NO: 421540 - DNA, 22 bp, Artificial Sequence
  Description of Artificial Sequence: Synthetic oligonucleotide
gacatcctggagcaggcggggg

SEQ ID NO: 421541 - DNA, 22 bp, Artificial Sequence
  Description of Artificial Sequence: Synthetic oligonucleotide
acatcctggagcaggcgggggc

SEQ ID NO: 421542 - DNA, 21 bp, Artificial Sequence
  Description of Artificial Sequence: Synthetic oligonucleotide
catcctggagcaggcgggggc

SEQ ID NO: 421543 - DNA, 21 bp, Artificial Sequence
  Description of Artificial Sequence: Synthetic oligonucleotide
atcctggagcaggcgggggcc

SEQ ID NO: 421544 - DNA, 20 bp, Artificial Sequence
  Description of Artificial Sequence: Synthetic oligonucleotide
tcctggagcaggcgggggcc

SEQ ID NO: 421545 - DNA, 20 bp, Artificial Sequence
  Description of Artificial Sequence: Synthetic oligonucleotide
cctggagcaggcgggggcct

SEQ ID NO: 421546 - DNA, 20 bp, Artificial Sequence
  Description of Artificial Sequence: Synthetic oligonucleotide
ctggagcaggcgggggccgt

SEQ ID NO: 421547 - DNA, 20 bp, Artificial Sequence
  Description of Artificial Sequence: Synthetic oligonucleotide
tggagcaggcgggggccgct

SEQ ID NO: 421548 - DNA, 20 bp, Artificial Sequence
  Description of Artificial Sequence: Synthetic oligonucleotide
ggagcaggcgggggccgctt

SEQ ID NO: 421549 - DNA, 20 bp, Artificial Sequence
  Description of Artificial Sequence: Synthetic oligonucleotide
gagcaggcgggggccgcgtt

SEQ ID NO: 421550 - DNA, 20 bp, Artificial Sequence
  Description of Artificial Sequence: Synthetic oligonucleotide
agcaggcgggggccgcggtt

SEQ ID NO: 421551 - DNA, 20 bp, Artificial Sequence
  Description of Artificial Sequence: Synthetic oligonucleotide
gcaggcgggggccgcggttt

SEQ ID NO: 421552 - DNA, 20 bp, Artificial Sequence
  Description of Artificial Sequence: Synthetic oligonucleotide
caggcgggggccgcggtgtt

SEQ ID NO: 421553 - DNA, 20 bp, Artificial Sequence
  Description of Artificial Sequence: Synthetic oligonucleotide
aggcgggggccgcggtggat

SEQ ID NO: 421554 - DNA, 20 bp, Artificial Sequence
  Description of Artificial Sequence: Synthetic oligonucleotide
ggcgggggccgcggtggatt

SEQ ID NO: 421555 - DNA, 20 bp, Artificial Sequence
  Description of Artificial Sequence: Synthetic oligonucleotide
gcgggggccgcggtggacat

SEQ ID NO: 421556 - DNA, 20 bp, Artificial Sequence
  Description of Artificial Sequence: Synthetic oligonucleotide
cgggggccgcggtggacact

SEQ ID NO: 421557 - DNA, 21 bp, Artificial Sequence
  Description of Artificial Sequence: Synthetic oligonucleotide
gggggccgcggtggacaccta

SEQ ID NO: 421558 - DNA, 22 bp, Artificial Sequence
  Description of Artificial Sequence: Synthetic oligonucleotide
ggggccgcggtggacacctact

SEQ ID NO: 421559 - DNA, 22 bp, Artificial Sequence
  Description of Artificial Sequence: Synthetic oligonucleotide
tgagggagctggggcggcctga

SEQ ID NO: 421560 - DNA, 21 bp, Artificial Sequence
  Description of Artificial Sequence: Synthetic oligonucleotide
gagggagctggggcggcctga

SEQ ID NO: 421561 - DNA, 21 bp, Artificial Sequence
  Description of Artificial Sequence: Synthetic oligonucleotide
agggagctggggcggcctgac

SEQ ID NO: 421562 - DNA, 20 bp, Artificial Sequence
  Description of Artificial Sequence: Synthetic oligonucleotide
gggagctggggcggcctgac

SEQ ID NO: 421563 - DNA, 29 bp, Artificial Sequence
  Description of Artificial Sequence: Synthetic oligonucleotide
gctgagtactggaacagccagaaggacac

SEQ ID NO: 421564 - DNA, 29 bp, Artificial Sequence
  Description of Artificial Sequence: Synthetic oligonucleotide
ctgagtactggaacagccagaaggacacc

SEQ ID NO: 421565 - DNA, 29 bp, Artificial Sequence
  Description of Artificial Sequence: Synthetic oligonucleotide
tgagtactggaacagccagaaggacaccc

SEQ ID NO: 421566 - DNA, 28 bp, Artificial Sequence
  Description of Artificial Sequence: Synthetic oligonucleotide
gagtactggaacagccagaaggacaccc

SEQ ID NO: 421567 - DNA, 29 bp, Artificial Sequence
  Description of Artificial Sequence: Synthetic oligonucleotide
agtactggaacagccagaaggacaccctg

SEQ ID NO: 421568 - DNA, 28 bp, Artificial Sequence
  Description of Artificial Sequence: Synthetic oligonucleotide
gtactggaacagccagaaggacaccctg

SEQ ID NO: 421569 - DNA, 28 bp, Artificial Sequence
  Description of Artificial Sequence: Synthetic oligonucleotide
tactggaacagccagaaggacaccctgg

SEQ ID NO: 421570 - DNA, 27 bp, Artificial Sequence
  Description of Artificial Sequence: Synthetic oligonucleotide
actggaacagccagaaggacaccctgg

SEQ ID NO: 421571 - DNA, 27 bp, Artificial Sequence
  Description of Artificial Sequence: Synthetic oligonucleotide
ctggaacagccagaaggacaccctgga

SEQ ID NO: 421572 - DNA, 27 bp, Artificial Sequence
  Description of Artificial Sequence: Synthetic oligonucleotide
tggaacagccagaaggacaccctggag

SEQ ID NO: 421573 - DNA, 26 bp, Artificial Sequence
  Description of Artificial Sequence: Synthetic oligonucleotide
ggaacagccagaaggacaccctggag

SEQ ID NO: 421574 - DNA, 27 bp, Artificial Sequence
  Description of Artificial Sequence: Synthetic oligonucleotide
gaacagccagaaggacaccctggagca

SEQ ID NO: 421575 - DNA, 27 bp, Artificial Sequence
  Description of Artificial Sequence: Synthetic oligonucleotide
aacagccagaaggacaccctggagcag

SEQ ID NO: 421576 - DNA, 26 bp, Artificial Sequence
  Description of Artificial Sequence: Synthetic oligonucleotide
acagccagaaggacaccctggagcag

SEQ ID NO: 421577 - DNA, 25 bp, Artificial Sequence
  Description of Artificial Sequence: Synthetic oligonucleotide
cagccagaaggacaccctggagcag

SEQ ID NO: 421578 - DNA, 25 bp, Artificial Sequence
  Description of Artificial Sequence: Synthetic oligonucleotide
agccagaaggacaccctggagcagg

SEQ ID NO: 421579 - DNA, 24 bp, Artificial Sequence
  Description of Artificial Sequence: Synthetic oligonucleotide
gccagaaggacaccctggagcagg

SEQ ID NO: 421580 - DNA, 24 bp, Artificial Sequence
  Description of Artificial Sequence: Synthetic oligonucleotide
ccagaaggacaccctggagcaggc

SEQ ID NO: 421581 - DNA, 24 bp, Artificial Sequence
  Description of Artificial Sequence: Synthetic oligonucleotide
cagaaggacaccctggagcaggcg

SEQ ID NO: 421582 - DNA, 24 bp, Artificial Sequence
  Description of Artificial Sequence: Synthetic oligonucleotide
agaaggacaccctggagcaggcgc

SEQ ID NO: 421583 - DNA, 23 bp, Artificial Sequence
  Description of Artificial Sequence: Synthetic oligonucleotide
gaaggacaccctggagcaggcgc

SEQ ID NO: 421584 - DNA, 23 bp, Artificial Sequence
  Description of Artificial Sequence: Synthetic oligonucleotide
aaggacaccctggagcaggcgcg

SEQ ID NO: 421585 - DNA, 22 bp, Artificial Sequence
  Description of Artificial Sequence: Synthetic oligonucleotide
aggacaccctggagcaggcgcg

SEQ ID NO: 421586 - DNA, 21 bp, Artificial Sequence
  Description of Artificial Sequence: Synthetic oligonucleotide
ggacaccctggagcaggcgcg

SEQ ID NO: 421587 - DNA, 21 bp, Artificial Sequence
  Description of Artificial Sequence: Synthetic oligonucleotide
gacaccctggagcaggcgcgg

SEQ ID NO: 421588 - DNA, 21 bp, Artificial Sequence
  Description of Artificial Sequence: Synthetic oligonucleotide
acaccctggagcaggcgcggg

SEQ ID NO: 421589 - DNA, 20 bp, Artificial Sequence
  Description of Artificial Sequence: Synthetic oligonucleotide
caccctggagcaggcgcggg

SEQ ID NO: 421590 - DNA, 20 bp, Artificial Sequence
  Description of Artificial Sequence: Synthetic oligonucleotide
accctggagcaggcgcgggc

SEQ ID NO: 421591 - DNA, 20 bp, Artificial Sequence
  Description of Artificial Sequence: Synthetic oligonucleotide
ccctggagcaggcgcgggct

SEQ ID NO: 421592 - DNA, 34 bp, Artificial Sequence
  Description of Artificial Sequence: Synthetic oligonucleotide
gatgcggttcctggacagatacttctataaccag

SEQ ID NO: 421593 - DNA, 34 bp, Artificial Sequence
  Description of Artificial Sequence: Synthetic oligonucleotide
atgcggttcctggacagatacttctataaccagg

SEQ ID NO: 421594 - DNA, 28 bp, Artificial Sequence
  Description of Artificial Sequence: Synthetic oligonucleotide
tgacgctgagtactggaacagccaggag

SEQ ID NO: 421595 - DNA, 27 bp, Artificial Sequence
  Description of Artificial Sequence: Synthetic oligonucleotide
gacgctgagtactggaacagccaggag

SEQ ID NO: 421596 - DNA, 27 bp, Artificial Sequence
  Description of Artificial Sequence: Synthetic oligonucleotide
acgctgagtactggaacagccaggagg

SEQ ID NO: 421597 - DNA, 27 bp, Artificial Sequence
  Description of Artificial Sequence: Synthetic oligonucleotide
cgctgagtactggaacagccaggagga

SEQ ID NO: 421598 - DNA, 27 bp, Artificial Sequence
  Description of Artificial Sequence: Synthetic oligonucleotide
gctgagtactggaacagccaggaggac

SEQ ID NO: 421599 - DNA, 29 bp, Artificial Sequence
  Description of Artificial Sequence: Synthetic oligonucleotide
ctgagtactggaacagccaggaggacatc

SEQ ID NO: 421600 - DNA, 29 bp, Artificial Sequence
  Description of Artificial Sequence: Synthetic oligonucleotide
tgagtactggaacagccaggaggacatcc

SEQ ID NO: 421601 - DNA, 28 bp, Artificial Sequence
  Description of Artificial Sequence: Synthetic oligonucleotide
gagtactggaacagccaggaggacatcc

SEQ ID NO: 421602 - DNA, 29 bp, Artificial Sequence
  Description of Artificial Sequence: Synthetic oligonucleotide
agtactggaacagccaggaggacatcctg

SEQ ID NO: 421603 - DNA, 28 bp, Artificial Sequence
  Description of Artificial Sequence: Synthetic oligonucleotide
gtactggaacagccaggaggacatcctg

SEQ ID NO: 421604 - DNA, 28 bp, Artificial Sequence
  Description of Artificial Sequence: Synthetic oligonucleotide
tactggaacagccaggaggacatcctgg

SEQ ID NO: 421605 - DNA, 27 bp, Artificial Sequence
  Description of Artificial Sequence: Synthetic oligonucleotide
actggaacagccaggaggacatcctgg

SEQ ID NO: 421606 - DNA, 27 bp, Artificial Sequence
  Description of Artificial Sequence: Synthetic oligonucleotide
ctggaacagccaggaggacatcctgga

SEQ ID NO: 421607 - DNA, 27 bp, Artificial Sequence
  Description of Artificial Sequence: Synthetic oligonucleotide
tggaacagccaggaggacatcctggag

SEQ ID NO: 421608 - DNA, 26 bp, Artificial Sequence
  Description of Artificial Sequence: Synthetic oligonucleotide
ggaacagccaggaggacatcctggag

SEQ ID NO: 421609 - DNA, 27 bp, Artificial Sequence
  Description of Artificial Sequence: Synthetic oligonucleotide
gaacagccaggaggacatcctggagca

SEQ ID NO: 421610 - DNA, 27 bp, Artificial Sequence
  Description of Artificial Sequence: Synthetic oligonucleotide
aacagccaggaggacatcctggagcag

SEQ ID NO: 421611 - DNA, 26 bp, Artificial Sequence
  Description of Artificial Sequence: Synthetic oligonucleotide
acagccaggaggacatcctggagcag

SEQ ID NO: 421612 - DNA, 25 bp, Artificial Sequence
  Description of Artificial Sequence: Synthetic oligonucleotide
cagccaggaggacatcctggagcag

SEQ ID NO: 421613 - DNA, 25 bp, Artificial Sequence
  Description of Artificial Sequence: Synthetic oligonucleotide
agccaggaggacatcctggagcagg

SEQ ID NO: 421614 - DNA, 24 bp, Artificial Sequence
  Description of Artificial Sequence: Synthetic oligonucleotide
gccaggaggacatcctggagcagg

SEQ ID NO: 421615 - DNA, 24 bp, Artificial Sequence
  Description of Artificial Sequence: Synthetic oligonucleotide
ccaggaggacatcctggagcaggc

SEQ ID NO: 421616 - DNA, 24 bp, Artificial Sequence
  Description of Artificial Sequence: Synthetic oligonucleotide
caggaggacatcctggagcaggcg

SEQ ID NO: 421617 - DNA, 24 bp, Artificial Sequence
  Description of Artificial Sequence: Synthetic oligonucleotide
aggaggacatcctggagcaggcgc

SEQ ID NO: 421618 - DNA, 23 bp, Artificial Sequence
  Description of Artificial Sequence: Synthetic oligonucleotide
ggaggacatcctggagcaggcgc

SEQ ID NO: 421619 - DNA, 23 bp, Artificial Sequence
  Description of Artificial Sequence: Synthetic oligonucleotide
gaggacatcctggagcaggcgcg

SEQ ID NO: 421620 - DNA, 34 bp, Artificial Sequence
  Description of Artificial Sequence: Synthetic oligonucleotide
tttcctgtggcagcctaagagggagtgtaatttc

SEQ ID NO: 421621 - DNA, 33 bp, Artificial Sequence
  Description of Artificial Sequence: Synthetic oligonucleotide
ttcctgtggcagcctaagagggagtgtaatttc

SEQ ID NO: 421622 - DNA, 32 bp, Artificial Sequence
  Description of Artificial Sequence: Synthetic oligonucleotide
tcctgtggcagcctaagagggagtgtaatttc

SEQ ID NO: 421623 - DNA, 31 bp, Artificial Sequence
  Description of Artificial Sequence: Synthetic oligonucleotide
cctgtggcagcctaagagggagtgtaatttc

SEQ ID NO: 421624 - DNA, 33 bp, Artificial Sequence
  Description of Artificial Sequence: Synthetic oligonucleotide
ctgtggcagcctaagagggagtgtaatttcttc

SEQ ID NO: 421625 - DNA, 36 bp, Artificial Sequence
  Description of Artificial Sequence: Synthetic oligonucleotide
tgtggcagcctaagagggagtgtaatttcttcaatg

SEQ ID NO: 421626 - DNA, 35 bp, Artificial Sequence
  Description of Artificial Sequence: Synthetic oligonucleotide
gtggcagcctaagagggagtgtaatttcttcaatg

SEQ ID NO: 421627 - DNA, 35 bp, Artificial Sequence
  Description of Artificial Sequence: Synthetic oligonucleotide
tggcagcctaagagggagtgtaatttcttcaatgg

SEQ ID NO: 421628 - DNA, 34 bp, Artificial Sequence
  Description of Artificial Sequence: Synthetic oligonucleotide
ggcagcctaagagggagtgtaatttcttcaatgg

SEQ ID NO: 421629 - DNA, 34 bp, Artificial Sequence
  Description of Artificial Sequence: Synthetic oligonucleotide
gcagcctaagagggagtgtaatttcttcaatggg

SEQ ID NO: 421630 - DNA, 35 bp, Artificial Sequence
  Description of Artificial Sequence: Synthetic oligonucleotide
cagcctaagagggagtgtaatttcttcaatgggac

SEQ ID NO: 421631 - DNA, 35 bp, Artificial Sequence
  Description of Artificial Sequence: Synthetic oligonucleotide
agcctaagagggagtgtaatttcttcaatgggacg

SEQ ID NO: 421632 - DNA, 34 bp, Artificial Sequence
  Description of Artificial Sequence: Synthetic oligonucleotide
gcctaagagggagtgtaatttcttcaatgggacg

SEQ ID NO: 421633 - DNA, 34 bp, Artificial Sequence
  Description of Artificial Sequence: Synthetic oligonucleotide
cctaagagggagtgtaatttcttcaatgggacgg

SEQ ID NO: 421634 - DNA, 35 bp, Artificial Sequence
  Description of Artificial Sequence: Synthetic oligonucleotide
ctaagagggagtgtaatttcttcaatgggacggag

SEQ ID NO: 421635 - DNA, 35 bp, Artificial Sequence
  Description of Artificial Sequence: Synthetic oligonucleotide
taagagggagtgtaatttcttcaatgggacggagc

SEQ ID NO: 421636 - DNA, 34 bp, Artificial Sequence
  Description of Artificial Sequence: Synthetic oligonucleotide
aagagggagtgtaatttcttcaatgggacggagc

SEQ ID NO: 421637 - DNA, 33 bp, Artificial Sequence
  Description of Artificial Sequence: Synthetic oligonucleotide
agagggagtgtaatttcttcaatgggacggagc

SEQ ID NO: 421638 - DNA, 32 bp, Artificial Sequence
  Description of Artificial Sequence: Synthetic oligonucleotide
gagggagtgtaatttcttcaatgggacggagc

SEQ ID NO: 421639 - DNA, 32 bp, Artificial Sequence
  Description of Artificial Sequence: Synthetic oligonucleotide
agggagtgtaatttcttcaatgggacggagcg

SEQ ID NO: 421640 - DNA, 31 bp, Artificial Sequence
  Description of Artificial Sequence: Synthetic oligonucleotide
gggagtgtaatttcttcaatgggacggagcg

SEQ ID NO: 421641 - DNA, 31 bp, Artificial Sequence
  Description of Artificial Sequence: Synthetic oligonucleotide
ggagtgtaatttcttcaatgggacggagcgg

SEQ ID NO: 421642 - DNA, 31 bp, Artificial Sequence
  Description of Artificial Sequence: Synthetic oligonucleotide
gagtgtaatttcttcaatgggacggagcggg

SEQ ID NO: 421643 - DNA, 32 bp, Artificial Sequence
  Description of Artificial Sequence: Synthetic oligonucleotide
agtgtaatttcttcaatgggacggagcgggtg

SEQ ID NO: 421644 - DNA, 31 bp, Artificial Sequence
  Description of Artificial Sequence: Synthetic oligonucleotide
gtgtaatttcttcaatgggacggagcgggtg

SEQ ID NO: 421645 - DNA, 31 bp, Artificial Sequence
  Description of Artificial Sequence: Synthetic oligonucleotide
tgtaatttcttcaatgggacggagcgggtgc

SEQ ID NO: 421646 - DNA, 30 bp, Artificial Sequence
  Description of Artificial Sequence: Synthetic oligonucleotide
gtaatttcttcaatgggacggagcgggtgc

SEQ ID NO: 421647 - DNA, 30 bp, Artificial Sequence
  Description of Artificial Sequence: Synthetic oligonucleotide
taatttcttcaatgggacggagcgggtgcg

SEQ ID NO: 421648 - DNA, 29 bp, Artificial Sequence
  Description of Artificial Sequence: Synthetic oligonucleotide
aatttcttcaatgggacggagcgggtgcg

SEQ ID NO: 421649 - DNA, 28 bp, Artificial Sequence
  Description of Artificial Sequence: Synthetic oligonucleotide
tataaccaggaggagtccgtgcgcttcc

SEQ ID NO: 421650 - DNA, 27 bp, Artificial Sequence
  Description of Artificial Sequence: Synthetic oligonucleotide
ataaccaggaggagtccgtgcgcttcc

SEQ ID NO: 421651 - DNA, 27 bp, Artificial Sequence
  Description of Artificial Sequence: Synthetic oligonucleotide
taaccaggaggagtccgtgcgcttcca

SEQ ID NO: 421652 - DNA, 26 bp, Artificial Sequence
  Description of Artificial Sequence: Synthetic oligonucleotide
aaccaggaggagtccgtgcgcttcca

SEQ ID NO: 421653 - DNA, 25 bp, Artificial Sequence
  Description of Artificial Sequence: Synthetic oligonucleotide
accaggaggagtccgtgcgcttcca

SEQ ID NO: 421654 - DNA, 24 bp, Artificial Sequence
  Description of Artificial Sequence: Synthetic oligonucleotide
ccaggaggagtccgtgcgcttcca

SEQ ID NO: 421655 - DNA, 25 bp, Artificial Sequence
  Description of Artificial Sequence: Synthetic oligonucleotide
caggaggagtccgtgcgcttccaca

SEQ ID NO: 421656 - DNA, 25 bp, Artificial Sequence
  Description of Artificial Sequence: Synthetic oligonucleotide
aggaggagtccgtgcgcttccacag

SEQ ID NO: 421657 - DNA, 24 bp, Artificial Sequence
  Description of Artificial Sequence: Synthetic oligonucleotide
ggaggagtccgtgcgcttccacag

SEQ ID NO: 421658 - DNA, 24 bp, Artificial Sequence
  Description of Artificial Sequence: Synthetic oligonucleotide
gaggagtccgtgcgcttccacagc

SEQ ID NO: 421659 - DNA, 25 bp, Artificial Sequence
  Description of Artificial Sequence: Synthetic oligonucleotide
aggagtccgtgcgcttccacagcga

SEQ ID NO: 421660 - DNA, 24 bp, Artificial Sequence
  Description of Artificial Sequence: Synthetic oligonucleotide
ggagtccgtgcgcttccacagcga

SEQ ID NO: 421661 - DNA, 24 bp, Artificial Sequence
  Description of Artificial Sequence: Synthetic oligonucleotide
gagtccgtgcgcttccacagcgac

SEQ ID NO: 421662 - DNA, 25 bp, Artificial Sequence
  Description of Artificial Sequence: Synthetic oligonucleotide
agtccgtgcgcttccacagcgacgt

SEQ ID NO: 421663 - DNA, 24 bp, Artificial Sequence
  Description of Artificial Sequence: Synthetic oligonucleotide
gtccgtgcgcttccacagcgacgt

SEQ ID NO: 421664 - DNA, 24 bp, Artificial Sequence
  Description of Artificial Sequence: Synthetic oligonucleotide
tccgtgcgcttccacagcgacgtg

SEQ ID NO: 421665 - DNA, 23 bp, Artificial Sequence
  Description of Artificial Sequence: Synthetic oligonucleotide
ccgtgcgcttccacagcgacgtg

SEQ ID NO: 421666 - DNA, 23 bp, Artificial Sequence
  Description of Artificial Sequence: Synthetic oligonucleotide
cgtgcgcttccacagcgacgtgg

SEQ ID NO: 421667 - DNA, 23 bp, Artificial Sequence
  Description of Artificial Sequence: Synthetic oligonucleotide
gtgcgcttccacagcgacgtggg

SEQ ID NO: 421668 - DNA, 23 bp, Artificial Sequence
  Description of Artificial Sequence: Synthetic oligonucleotide
tgcgcttccacagcgacgtgggg

SEQ ID NO: 421669 - DNA, 22 bp, Artificial Sequence
  Description of Artificial Sequence: Synthetic oligonucleotide
gcgcttccacagcgacgtgggg

SEQ ID NO: 421670 - DNA, 23 bp, Artificial Sequence
  Description of Artificial Sequence: Synthetic oligonucleotide
cgcttccacagcgacgtggggga

SEQ ID NO: 421671 - DNA, 25 bp, Artificial Sequence
  Description of Artificial Sequence: Synthetic oligonucleotide
gcttccacagcgacgtgggggagtt

SEQ ID NO: 421672 - DNA, 25 bp, Artificial Sequence
  Description of Artificial Sequence: Synthetic oligonucleotide
cttccacagcgacgtgggggagttc

SEQ ID NO: 421673 - DNA, 25 bp, Artificial Sequence
  Description of Artificial Sequence: Synthetic oligonucleotide
ttccacagcgacgtgggggagttcc

SEQ ID NO: 421674 - DNA, 24 bp, Artificial Sequence
  Description of Artificial Sequence: Synthetic oligonucleotide
tccacagcgacgtgggggagttcc

SEQ ID NO: 421675 - DNA, 23 bp, Artificial Sequence
  Description of Artificial Sequence: Synthetic oligonucleotide
ccacagcgacgtgggggagttcc

SEQ ID NO: 421676 - DNA, 23 bp, Artificial Sequence
  Description of Artificial Sequence: Synthetic oligonucleotide
cacagcgacgtgggggagttccg

SEQ ID NO: 421677 - DNA, 24 bp, Artificial Sequence
  Description of Artificial Sequence: Synthetic oligonucleotide
agtccgtgcgcttcgacagcgacg

SEQ ID NO: 421678 - DNA, 23 bp, Artificial Sequence
  Description of Artificial Sequence: Synthetic oligonucleotide
gtccgtgcgcttcgacagcgacg

SEQ ID NO: 421679 - DNA, 23 bp, Artificial Sequence
  Description of Artificial Sequence: Synthetic oligonucleotide
tccgtgcgcttcgacagcgacgg

SEQ ID NO: 421680 - DNA, 22 bp, Artificial Sequence
  Description of Artificial Sequence: Synthetic oligonucleotide
ccgtgcgcttcgacagcgacgg

SEQ ID NO: 421681 - DNA, 24 bp, Artificial Sequence
  Description of Artificial Sequence: Synthetic oligonucleotide
cttcgacagcgacgggggggagtt

SEQ ID NO: 421682 - DNA, 24 bp, Artificial Sequence
  Description of Artificial Sequence: Synthetic oligonucleotide
ttcgacagcgacgggggggagttc

SEQ ID NO: 421683 - DNA, 23 bp, Artificial Sequence
  Description of Artificial Sequence: Synthetic oligonucleotide
tcgacagcgacgggggggagttc

SEQ ID NO: 421684 - DNA, 22 bp, Artificial Sequence
  Description of Artificial Sequence: Synthetic oligonucleotide
cgacagcgacgggggggagttc

SEQ ID NO: 421685 - DNA, 22 bp, Artificial Sequence
  Description of Artificial Sequence: Synthetic oligonucleotide
gacagcgacgggggggagttcc

SEQ ID NO: 421686 - DNA, 22 bp, Artificial Sequence
  Description of Artificial Sequence: Synthetic oligonucleotide
acagcgacgggggggagttccg

SEQ ID NO: 421687 - DNA, 21 bp, Artificial Sequence
  Description of Artificial Sequence: Synthetic oligonucleotide
cagcgacgggggggagttccg

SEQ ID NO: 421688 - DNA, 21 bp, Artificial Sequence
  Description of Artificial Sequence: Synthetic oligonucleotide
agcgacgggggggagttccgg

SEQ ID NO: 421689 - DNA, 20 bp, Artificial Sequence
  Description of Artificial Sequence: Synthetic oligonucleotide
gcgacgggggggagttccgg

SEQ ID NO: 421690 - DNA, 20 bp, Artificial Sequence
  Description of Artificial Sequence: Synthetic oligonucleotide
cgacgggggggagttccggg

SEQ ID NO: 421691 - DNA, 20 bp, Artificial Sequence
  Description of Artificial Sequence: Synthetic oligonucleotide
gacgggggggagttccgggc

SEQ ID NO: 421692 - DNA, 20 bp, Artificial Sequence
  Description of Artificial Sequence: Synthetic oligonucleotide
acgggggggagttccgggcg

SEQ ID NO: 421693 - DNA, 20 bp, Artificial Sequence
  Description of Artificial Sequence: Synthetic oligonucleotide
cgggggggagttccgggcgt

SEQ ID NO: 421694 - DNA, 20 bp, Artificial Sequence
  Description of Artificial Sequence: Synthetic oligonucleotide
gggggggagttccgggcggt

SEQ ID NO: 421695 - DNA, 21 bp, Artificial Sequence
  Description of Artificial Sequence: Synthetic oligonucleotide
ggggggagttccgggcggtga

SEQ ID NO: 421696 - DNA, 23 bp, Artificial Sequence
  Description of Artificial Sequence: Synthetic oligonucleotide
gcgcgggccgcggtggacaatta

SEQ ID NO: 421697 - DNA, 24 bp, Artificial Sequence
  Description of Artificial Sequence: Synthetic oligonucleotide
cgcgggccgcggtggacaattact

SEQ ID NO: 421698 - DNA, 23 bp, Artificial Sequence
  Description of Artificial Sequence: Synthetic oligonucleotide
aatgggacggagcgggtgcggtg

SEQ ID NO: 421699 - DNA, 22 bp, Artificial Sequence
  Description of Artificial Sequence: Synthetic oligonucleotide
atgggacggagcgggtgcggtg

SEQ ID NO: 421700 - DNA, 21 bp, Artificial Sequence
  Description of Artificial Sequence: Synthetic oligonucleotide
tgggacggagcgggtgcggtg

SEQ ID NO: 421701 - DNA, 20 bp, Artificial Sequence
  Description of Artificial Sequence: Synthetic oligonucleotide
gggacggagcgggtgcggtg

SEQ ID NO: 421702 - DNA, 20 bp, Artificial Sequence
  Description of Artificial Sequence: Synthetic oligonucleotide
ggacggagcgggtgcggtgg

SEQ ID NO: 421703 - DNA, 21 bp, Artificial Sequence
  Description of Artificial Sequence: Synthetic oligonucleotide
gacggagcgggtgcggtggct

SEQ ID NO: 421704 - DNA, 21 bp, Artificial Sequence
  Description of Artificial Sequence: Synthetic oligonucleotide
acggagcgggtgcggtggctg

SEQ ID NO: 421705 - DNA, 20 bp, Artificial Sequence
  Description of Artificial Sequence: Synthetic oligonucleotide
cggagcgggtgcggtggctg

SEQ ID NO: 421706 - DNA, 21 bp, Artificial Sequence
  Description of Artificial Sequence: Synthetic oligonucleotide
ggagcgggtgcggtggctgga

SEQ ID NO: 421707 - DNA, 22 bp, Artificial Sequence
  Description of Artificial Sequence: Synthetic oligonucleotide
gagcgggtgcggtggctggaca

SEQ ID NO: 421708 - DNA, 25 bp, Artificial Sequence
  Description of Artificial Sequence: Synthetic oligonucleotide
agcgggtgcggtggctggacagata

SEQ ID NO: 421709 - DNA, 24 bp, Artificial Sequence
  Description of Artificial Sequence: Synthetic oligonucleotide
gcgggtgcggtggctggacagata

SEQ ID NO: 421710 - DNA, 26 bp, Artificial Sequence
  Description of Artificial Sequence: Synthetic oligonucleotide
cgggtgcggtggctggacagatactt

SEQ ID NO: 421711 - DNA, 27 bp, Artificial Sequence
  Description of Artificial Sequence: Synthetic oligonucleotide
gggtgcggtggctggacagatacttct

SEQ ID NO: 421712 - DNA, 31 bp, Artificial Sequence
  Description of Artificial Sequence: Synthetic oligonucleotide
ggtgcggtggctggacagatacttctataac

SEQ ID NO: 421713 - DNA, 31 bp, Artificial Sequence
  Description of Artificial Sequence: Synthetic oligonucleotide
gtgcggtggctggacagatacttctataacc

SEQ ID NO: 421714 - DNA, 32 bp, Artificial Sequence
  Description of Artificial Sequence: Synthetic oligonucleotide
tgcggtggctggacagatacttctataaccag

SEQ ID NO: 421715 - DNA, 31 bp, Artificial Sequence
  Description of Artificial Sequence: Synthetic oligonucleotide
gcggtggctggacagatacttctataaccag

SEQ ID NO: 421716 - DNA, 31 bp, Artificial Sequence
  Description of Artificial Sequence: Synthetic oligonucleotide
cggtggctggacagatacttctataaccagg

SEQ ID NO: 421717 - DNA, 32 bp, Artificial Sequence
  Description of Artificial Sequence: Synthetic oligonucleotide
ggtggctggacagatacttctataaccaggag

SEQ ID NO: 421718 - DNA, 32 bp, Artificial Sequence
  Description of Artificial Sequence: Synthetic oligonucleotide
gtggctggacagatacttctataaccaggagg

SEQ ID NO: 421719 - DNA, 33 bp, Artificial Sequence
  Description of Artificial Sequence: Synthetic oligonucleotide
tggctggacagatacttctataaccaggaggag

SEQ ID NO: 421720 - DNA, 32 bp, Artificial Sequence
  Description of Artificial Sequence: Synthetic oligonucleotide
ggctggacagatacttctataaccaggaggag

SEQ ID NO: 421721 - DNA, 33 bp, Artificial Sequence
  Description of Artificial Sequence: Synthetic oligonucleotide
gctggacagatacttctataaccaggaggagtc

SEQ ID NO: 421722 - DNA, 24 bp, Artificial Sequence
  Description of Artificial Sequence: Synthetic oligonucleotide
gctggggacacccgaccacgtttc

SEQ ID NO: 421723 - DNA, 28 bp, Artificial Sequence
  Description of Artificial Sequence: Synthetic oligonucleotide
agccagaaggacttcctggaagacaggg

SEQ ID NO: 421724 - DNA, 27 bp, Artificial Sequence
  Description of Artificial Sequence: Synthetic oligonucleotide
gccagaaggacttcctggaagacaggg

SEQ ID NO: 421725 - DNA, 27 bp, Artificial Sequence
  Description of Artificial Sequence: Synthetic oligonucleotide
ccagaaggacttcctggaagacagggc

SEQ ID NO: 421726 - DNA, 27 bp, Artificial Sequence
  Description of Artificial Sequence: Synthetic oligonucleotide
cagaaggacttcctggaagacagggcc

SEQ ID NO: 421727 - DNA, 27 bp, Artificial Sequence
  Description of Artificial Sequence: Synthetic oligonucleotide
agaaggacttcctggaagacagggccg

SEQ ID NO: 421728 - DNA, 26 bp, Artificial Sequence
  Description of Artificial Sequence: Synthetic oligonucleotide
gaaggacttcctggaagacagggccg

SEQ ID NO: 421729 - DNA, 26 bp, Artificial Sequence
  Description of Artificial Sequence: Synthetic oligonucleotide
aaggacttcctggaagacagggccgc

SEQ ID NO: 421730 - DNA, 25 bp, Artificial Sequence
  Description of Artificial Sequence: Synthetic oligonucleotide
aggacttcctggaagacagggccgc

SEQ ID NO: 421731 - DNA, 24 bp, Artificial Sequence
  Description of Artificial Sequence: Synthetic oligonucleotide
ggacttcctggaagacagggccgc

SEQ ID NO: 421732 - DNA, 24 bp, Artificial Sequence
  Description of Artificial Sequence: Synthetic oligonucleotide
gacttcctggaagacagggccgcc

SEQ ID NO: 421733 - DNA, 24 bp, Artificial Sequence
  Description of Artificial Sequence: Synthetic oligonucleotide
acttcctggaagacagggccgccg

SEQ ID NO: 421734 - DNA, 23 bp, Artificial Sequence
  Description of Artificial Sequence: Synthetic oligonucleotide
cttcctggaagacagggccgccg

SEQ ID NO: 421735 - DNA, 23 bp, Artificial Sequence
  Description of Artificial Sequence: Synthetic oligonucleotide
ttcctggaagacagggccgccgc

SEQ ID NO: 421736 - DNA, 22 bp, Artificial Sequence
  Description of Artificial Sequence: Synthetic oligonucleotide
tcctggaagacagggccgccgc

SEQ ID NO: 421737 - DNA, 21 bp, Artificial Sequence
  Description of Artificial Sequence: Synthetic oligonucleotide
cctggaagacagggccgccgc

SEQ ID NO: 421738 - DNA, 21 bp, Artificial Sequence
  Description of Artificial Sequence: Synthetic oligonucleotide
ctggaagacagggccgccgcg

SEQ ID NO: 421739 - DNA, 22 bp, Artificial Sequence
  Description of Artificial Sequence: Synthetic oligonucleotide
tggaagacagggccgccgcggt

SEQ ID NO: 421740 - DNA, 21 bp, Artificial Sequence
  Description of Artificial Sequence: Synthetic oligonucleotide
ggaagacagggccgccgcggt

SEQ ID NO: 421741 - DNA, 21 bp, Artificial Sequence
  Description of Artificial Sequence: Synthetic oligonucleotide
gaagacagggccgccgcggtg

SEQ ID NO: 421742 - DNA, 22 bp, Artificial Sequence
  Description of Artificial Sequence: Synthetic oligonucleotide
aagacagggccgccgcggtgga

SEQ ID NO: 421743 - DNA, 21 bp, Artificial Sequence
  Description of Artificial Sequence: Synthetic oligonucleotide
agacagggccgccgcggtgga

SEQ ID NO: 421744 - DNA, 20 bp, Artificial Sequence
  Description of Artificial Sequence: Synthetic oligonucleotide
gacagggccgccgcggtgga

SEQ ID NO: 421745 - DNA, 21 bp, Artificial Sequence
  Description of Artificial Sequence: Synthetic oligonucleotide
acagggccgccgcggtggaca

SEQ ID NO: 421746 - DNA, 20 bp, Artificial Sequence
  Description of Artificial Sequence: Synthetic oligonucleotide
cagggccgccgcggtggaca

SEQ ID NO: 421747 - DNA, 20 bp, Artificial Sequence
  Description of Artificial Sequence: Synthetic oligonucleotide
agggccgccgcggtggacac

SEQ ID NO: 421748 - DNA, 20 bp, Artificial Sequence
  Description of Artificial Sequence: Synthetic oligonucleotide
gggccgccgcggtggacact

SEQ ID NO: 421749 - DNA, 21 bp, Artificial Sequence
  Description of Artificial Sequence: Synthetic oligonucleotide
ggccgccgcggtggacaccta

SEQ ID NO: 421750 - DNA, 22 bp, Artificial Sequence
  Description of Artificial Sequence: Synthetic oligonucleotide
gccgccgcggtggacacctact

SEQ ID NO: 421751 - DNA, 22 bp, Artificial Sequence
  Description of Artificial Sequence: Synthetic oligonucleotide
ccgccgcggtggacacctactg

SEQ ID NO: 421752 - DNA, 25 bp, Artificial Sequence
  Description of Artificial Sequence: Synthetic oligonucleotide
cttcacggtgcagcggcgagtccaa

SEQ ID NO: 421753 - DNA, 25 bp, Artificial Sequence
  Description of Artificial Sequence: Synthetic oligonucleotide
ttcacggtgcagcggcgagtccaac

SEQ ID NO: 421754 - DNA, 24 bp, Artificial Sequence
  Description of Artificial Sequence: Synthetic oligonucleotide
tcacggtgcagcggcgagtccaac

SEQ ID NO: 421755 - DNA, 23 bp, Artificial Sequence
  Description of Artificial Sequence: Synthetic oligonucleotide
cacggtgcagcggcgagtccaac

SEQ ID NO: 421756 - DNA, 26 bp, Artificial Sequence
  Description of Artificial Sequence: Synthetic oligonucleotide
acggtgcagcggcgagtccaacctaa

SEQ ID NO: 421757 - DNA, 25 bp, Artificial Sequence
  Description of Artificial Sequence: Synthetic oligonucleotide
cggtgcagcggcgagtccaacctaa

SEQ ID NO: 421758 - DNA, 25 bp, Artificial Sequence
  Description of Artificial Sequence: Synthetic oligonucleotide
ggtgcagcggcgagtccaacctaag

SEQ ID NO: 421759 - DNA, 26 bp, Artificial Sequence
  Description of Artificial Sequence: Synthetic oligonucleotide
agaaggacatcctggaggacaggcgc

SEQ ID NO: 421760 - DNA, 25 bp, Artificial Sequence
  Description of Artificial Sequence: Synthetic oligonucleotide
gaaggacatcctggaggacaggcgc

SEQ ID NO: 421761 - DNA, 25 bp, Artificial Sequence
  Description of Artificial Sequence: Synthetic oligonucleotide
aaggacatcctggaggacaggcgcg

SEQ ID NO: 421762 - DNA, 24 bp, Artificial Sequence
  Description of Artificial Sequence: Synthetic oligonucleotide
aggacatcctggaggacaggcgcg

SEQ ID NO: 421763 - DNA, 23 bp, Artificial Sequence
  Description of Artificial Sequence: Synthetic oligonucleotide
ggacatcctggaggacaggcgcg

SEQ ID NO: 421764 - DNA, 23 bp, Artificial Sequence
  Description of Artificial Sequence: Synthetic oligonucleotide
gacatcctggaggacaggcgcgc

SEQ ID NO: 421765 - DNA, 23 bp, Artificial Sequence
  Description of Artificial Sequence: Synthetic oligonucleotide
acatcctggaggacaggcgcgcc

SEQ ID NO: 421766 - DNA, 22 bp, Artificial Sequence
  Description of Artificial Sequence: Synthetic oligonucleotide
catcctggaggacaggcgcgcc

SEQ ID NO: 421767 - DNA, 22 bp, Artificial Sequence
  Description of Artificial Sequence: Synthetic oligonucleotide
atcctggaggacaggcgcgccg

SEQ ID NO: 421768 - DNA, 21 bp, Artificial Sequence
  Description of Artificial Sequence: Synthetic oligonucleotide
tcctggaggacaggcgcgccg

SEQ ID NO: 421769 - DNA, 20 bp, Artificial Sequence
  Description of Artificial Sequence: Synthetic oligonucleotide
cctggaggacaggcgcgccg

SEQ ID NO: 421770 - DNA, 20 bp, Artificial Sequence
  Description of Artificial Sequence: Synthetic oligonucleotide
ctggaggacaggcgcgccgc

SEQ ID NO: 421771 - DNA, 20 bp, Artificial Sequence
  Description of Artificial Sequence: Synthetic oligonucleotide
tggaggacaggcgcgccgcg

SEQ ID NO: 421772 - DNA, 20 bp, Artificial Sequence
  Description of Artificial Sequence: Synthetic oligonucleotide
ggaggacaggcgcgccgcgt

SEQ ID NO: 421773 - DNA, 20 bp, Artificial Sequence
  Description of Artificial Sequence: Synthetic oligonucleotide
gaggacaggcgcgccgcggt

SEQ ID NO: 421774 - DNA, 20 bp, Artificial Sequence
  Description of Artificial Sequence: Synthetic oligonucleotide
aggacaggcgcgccgcggtg

SEQ ID NO: 421775 - DNA, 20 bp, Artificial Sequence
  Description of Artificial Sequence: Synthetic oligonucleotide
ggacaggcgcgccgcggtgt

SEQ ID NO: 421776 - DNA, 21 bp, Artificial Sequence
  Description of Artificial Sequence: Synthetic oligonucleotide
ggacggagcgggtgcggttcc

SEQ ID NO: 421777 - DNA, 21 bp, Artificial Sequence
  Description of Artificial Sequence: Synthetic oligonucleotide
gacggagcgggtgcggttccc

SEQ ID NO: 421778 - DNA, 21 bp, Artificial Sequence
  Description of Artificial Sequence: Synthetic oligonucleotide
acggagcgggtgcggttcccg

SEQ ID NO: 421779 - DNA, 20 bp, Artificial Sequence
  Description of Artificial Sequence: Synthetic oligonucleotide
cggagcgggtgcggttcccg

SEQ ID NO: 421780 - DNA, 21 bp, Artificial Sequence
  Description of Artificial Sequence: Synthetic oligonucleotide
ggagcgggtgcggttcccgga

SEQ ID NO: 421781 - DNA, 22 bp, Artificial Sequence
  Description of Artificial Sequence: Synthetic oligonucleotide
gagcgggtgcggttcccggaca

SEQ ID NO: 421782 - DNA, 25 bp, Artificial Sequence
  Description of Artificial Sequence: Synthetic oligonucleotide
agcgggtgcggttcccggacagata

SEQ ID NO: 421783 - DNA, 24 bp, Artificial Sequence
  Description of Artificial Sequence: Synthetic oligonucleotide
gcgggtgcggttcccggacagata

SEQ ID NO: 421784 - DNA, 26 bp, Artificial Sequence
  Description of Artificial Sequence: Synthetic oligonucleotide
cgggtgcggttcccggacagatactt

SEQ ID NO: 421785 - DNA, 27 bp, Artificial Sequence
  Description of Artificial Sequence: Synthetic oligonucleotide
gggtgcggttcccggacagatacttct

SEQ ID NO: 421786 - DNA, 31 bp, Artificial Sequence; identical to SEQ ID NO: 73563
  Description of Artificial Sequence: Synthetic oligonucleotide

SEQ ID NO: 421787 - DNA, 31 bp, Artificial Sequence; identical to SEQ ID NO: 73564
  Description of Artificial Sequence: Synthetic oligonucleotide

SEQ ID NO: 421788 - DNA, 32 bp, Artificial Sequence; identical to SEQ ID NO: 73565
  Description of Artificial Sequence: Synthetic oligonucleotide

SEQ ID NO: 421789 - DNA, 31 bp, Artificial Sequence; identical to SEQ ID NO: 73566
  Description of Artificial Sequence: Synthetic oligonucleotide

SEQ ID NO: 421790 - DNA, 31 bp, Artificial Sequence; identical to SEQ ID NO: 73567
  Description of Artificial Sequence: Synthetic oligonucleotide

SEQ ID NO: 421791 - DNA, 32 bp, Artificial Sequence; identical to SEQ ID NO: 73568
  Description of Artificial Sequence: Synthetic oligonucleotide

SEQ ID NO: 421792 - DNA, 32 bp, Artificial Sequence; identical to SEQ ID NO: 73569
  Description of Artificial Sequence: Synthetic oligonucleotide

SEQ ID NO: 421793 - DNA, 33 bp, Artificial Sequence; identical to SEQ ID NO: 73570
  Description of Artificial Sequence: Synthetic oligonucleotide

SEQ ID NO: 421794 - DNA, 32 bp, Artificial Sequence; identical to SEQ ID NO: 73571
  Description of Artificial Sequence: Synthetic oligonucleotide

SEQ ID NO: 421795 - DNA, 31 bp, Artificial Sequence; identical to SEQ ID NO: 73572
  Description of Artificial Sequence: Synthetic oligonucleotide

SEQ ID NO: 421796 - DNA, 32 bp, Artificial Sequence; identical to SEQ ID NO: 73573
  Description of Artificial Sequence: Synthetic oligonucleotide

SEQ ID NO: 421797 - DNA, 32 bp, Artificial Sequence; identical to SEQ ID NO: 73574
  Description of Artificial Sequence: Synthetic oligonucleotide

SEQ ID NO: 421798 - DNA, 29 bp, Artificial Sequence
  Description of Artificial Sequence: Synthetic oligonucleotide
cacgtttcctgtggcagcctaagaggaag

SEQ ID NO: 421799 - DNA, 30 bp, Artificial Sequence; identical to SEQ ID NO: 73576
  Description of Artificial Sequence: Synthetic oligonucleotide

SEQ ID NO: 421800 - DNA, 29 bp, Artificial Sequence
  Description of Artificial Sequence: Synthetic oligonucleotide
cgtttcctgtggcagcctaagaggaagtg

SEQ ID NO: 421801 - DNA, 30 bp, Artificial Sequence; identical to SEQ ID NO: 73578
  Description of Artificial Sequence: Synthetic oligonucleotide

SEQ ID NO: 421802 - DNA, 34 bp, Artificial Sequence; identical to SEQ ID NO: 73579
  Description of Artificial Sequence: Synthetic oligonucleotide

SEQ ID NO: 421803 - DNA, 33 bp, Artificial Sequence; identical to SEQ ID NO: 73580
  Description of Artificial Sequence: Synthetic oligonucleotide

SEQ ID NO: 421804 - DNA, 32 bp, Artificial Sequence; identical to SEQ ID NO: 73581
  Description of Artificial Sequence: Synthetic oligonucleotide

SEQ ID NO: 421805 - DNA, 31 bp, Artificial Sequence; identical to SEQ ID NO: 73582
  Description of Artificial Sequence: Synthetic oligonucleotide

SEQ ID NO: 421806 - DNA, 33 bp, Artificial Sequence; identical to SEQ ID NO: 73583
  Description of Artificial Sequence: Synthetic oligonucleotide

SEQ ID NO: 421807 - DNA, 36 bp, Artificial Sequence; identical to SEQ ID NO: 73584
  Description of Artificial Sequence: Synthetic oligonucleotide

SEQ ID NO: 421808 - DNA, 35 bp, Artificial Sequence; identical to SEQ ID NO: 73585
  Description of Artificial Sequence: Synthetic oligonucleotide

SEQ ID NO: 421809 - DNA, 35 bp, Artificial Sequence; identical to SEQ ID NO: 73586
  Description of Artificial Sequence: Synthetic oligonucleotide

SEQ ID NO: 421810 - DNA, 34 bp, Artificial Sequence; identical to SEQ ID NO: 73587
  Description of Artificial Sequence: Synthetic oligonucleotide

SEQ ID NO: 421811 - DNA, 34 bp, Artificial Sequence; identical to SEQ ID NO: 73588
  Description of Artificial Sequence: Synthetic oligonucleotide

SEQ ID NO: 421812 - DNA, 35 bp, Artificial Sequence; identical to SEQ ID NO: 73589
  Description of Artificial Sequence: Synthetic oligonucleotide

SEQ ID NO: 421813 - DNA, 35 bp, Artificial Sequence; identical to SEQ ID NO: 73590
  Description of Artificial Sequence: Synthetic oligonucleotide

SEQ ID NO: 421814 - DNA, 34 bp, Artificial Sequence; identical to SEQ ID NO: 73591
  Description of Artificial Sequence: Synthetic oligonucleotide

SEQ ID NO: 421815 - DNA, 34 bp, Artificial Sequence; identical to SEQ ID NO: 73592
  Description of Artificial Sequence: Synthetic oligonucleotide

SEQ ID NO: 421816 - DNA, 35 bp, Artificial Sequence; identical to SEQ ID NO: 73593
  Description of Artificial Sequence: Synthetic oligonucleotide

SEQ ID NO: 421817 - DNA, 35 bp, Artificial Sequence; identical to SEQ ID NO: 73594
  Description of Artificial Sequence: Synthetic oligonucleotide

SEQ ID NO: 421818 - DNA, 34 bp, Artificial Sequence; identical to SEQ ID NO: 73595
  Description of Artificial Sequence: Synthetic oligonucleotide

SEQ ID NO: 421819 - DNA, 33 bp, Artificial Sequence; identical to SEQ ID NO: 73596
  Description of Artificial Sequence: Synthetic oligonucleotide

SEQ ID NO: 421820 - DNA, 32 bp, Artificial Sequence; identical to SEQ ID NO: 73597
  Description of Artificial Sequence: Synthetic oligonucleotide

SEQ ID NO: 421821 - DNA, 32 bp, Artificial Sequence; identical to SEQ ID NO: 73598
  Description of Artificial Sequence: Synthetic oligonucleotide

SEQ ID NO: 421822 - DNA, 31 bp, Artificial Sequence; identical to SEQ ID NO: 73599
  Description of Artificial Sequence: Synthetic oligonucleotide

SEQ ID NO: 421823 - DNA, 31 bp, Artificial Sequence; identical to SEQ ID NO: 73600
  Description of Artificial Sequence: Synthetic oligonucleotide

SEQ ID NO: 421824 - DNA, 31 bp, Artificial Sequence; identical to SEQ ID NO: 73601
  Description of Artificial Sequence: Synthetic oligonucleotide

SEQ ID NO: 421825 - DNA, 23 bp, Artificial Sequence
  Description of Artificial Sequence: Synthetic oligonucleotide
tgacggagctggggcggcctgaa

SEQ ID NO: 421826 - DNA, 22 bp, Artificial Sequence
  Description of Artificial Sequence: Synthetic oligonucleotide
gacggagctggggcggcctgaa

SEQ ID NO: 421827 - DNA, 22 bp, Artificial Sequence
  Description of Artificial Sequence: Synthetic oligonucleotide
acggagctggggcggcctgaag

SEQ ID NO: 421828 - DNA, 21 bp, Artificial Sequence
  Description of Artificial Sequence: Synthetic oligonucleotide
cggagctggggcggcctgaag

SEQ ID NO: 421829 - DNA, 22 bp, Artificial Sequence
  Description of Artificial Sequence: Synthetic oligonucleotide
ggagctggggcggcctgaagct

SEQ ID NO: 421830 - DNA, 23 bp, Artificial Sequence
  Description of Artificial Sequence: Synthetic oligonucleotide
gagctggggcggcctgaagctga

SEQ ID NO: 421831 - DNA, 25 bp, Artificial Sequence
  Description of Artificial Sequence: Synthetic oligonucleotide
agctggggcggcctgaagctgagta

SEQ ID NO: 421832 - DNA, 24 bp, Artificial Sequence
  Description of Artificial Sequence: Synthetic oligonucleotide
gctggggcggcctgaagctgagta

SEQ ID NO: 421833 - DNA, 25 bp, Artificial Sequence
  Description of Artificial Sequence: Synthetic oligonucleotide
ctggggcggcctgaagctgagtact

SEQ ID NO: 421834 - DNA, 25 bp, Artificial Sequence
  Description of Artificial Sequence: Synthetic oligonucleotide
tggggcggcctgaagctgagtactg

SEQ ID NO: 421835 - DNA, 24 bp, Artificial Sequence
  Description of Artificial Sequence: Synthetic oligonucleotide
ggggcggcctgaagctgagtactg

SEQ ID NO: 421836 - DNA, 26 bp, Artificial Sequence
  Description of Artificial Sequence: Synthetic oligonucleotide
gggcggcctgaagctgagtactggaa

SEQ ID NO: 421837 - DNA, 27 bp, Artificial Sequence
  Description of Artificial Sequence: Synthetic oligonucleotide
ggcggcctgaagctgagtactggaaca

SEQ ID NO: 421838 - DNA, 27 bp, Artificial Sequence
  Description of Artificial Sequence: Synthetic oligonucleotide
gcggcctgaagctgagtactggaacag

SEQ ID NO: 421839 - DNA, 27 bp, Artificial Sequence
  Description of Artificial Sequence: Synthetic oligonucleotide
cggcctgaagctgagtactggaacagc

SEQ ID NO: 421840 - DNA, 27 bp, Artificial Sequence
  Description of Artificial Sequence: Synthetic oligonucleotide
ggcctgaagctgagtactggaacagcc

SEQ ID NO: 421841 - DNA, 28 bp, Artificial Sequence
  Description of Artificial Sequence: Synthetic oligonucleotide
gcctgaagctgagtactggaacagccag

SEQ ID NO: 421842 - DNA, 30 bp, Artificial Sequence; identical to SEQ ID NO: 73641
  Description of Artificial Sequence: Synthetic oligonucleotide

SEQ ID NO: 421843 - DNA, 30 bp, Artificial Sequence; identical to SEQ ID NO: 73642
  Description of Artificial Sequence: Synthetic oligonucleotide

SEQ ID NO: 421844 - DNA, 31 bp, Artificial Sequence; identical to SEQ ID NO: 73643
  Description of Artificial Sequence: Synthetic oligonucleotide

SEQ ID NO: 421845 - DNA, 30 bp, Artificial Sequence; identical to SEQ ID NO: 73644
  Description of Artificial Sequence: Synthetic oligonucleotide

SEQ ID NO: 421846 - DNA, 30 bp, Artificial Sequence; identical to SEQ ID NO: 73645
  Description of Artificial Sequence: Synthetic oligonucleotide

SEQ ID NO: 421847 - DNA, 29 bp, Artificial Sequence
  Description of Artificial Sequence: Synthetic oligonucleotide
agctgagtactggaacagccagaaggacc

SEQ ID NO: 421848 - DNA, 25 bp, Artificial Sequence
  Description of Artificial Sequence: Synthetic oligonucleotide
ctggcccctggtcctgtcctcttct

SEQ ID NO: 421849 - DNA, 25 bp, Artificial Sequence
  Description of Artificial Sequence: Synthetic oligonucleotide
tggcccctggtcctgtcctcttctc

SEQ ID NO: 421850 - DNA, 24 bp, Artificial Sequence
  Description of Artificial Sequence: Synthetic oligonucleotide
ggcccctggtcctgtcctcttctc

SEQ ID NO: 421851 - DNA, 25 bp, Artificial Sequence
  Description of Artificial Sequence: Synthetic oligonucleotide
gcccctggtcctgtcctcttctcca

SEQ ID NO: 421852 - DNA, 25 bp, Artificial Sequence
  Description of Artificial Sequence: Synthetic oligonucleotide
cccctggtcctgtcctcttctccag

SEQ ID NO: 421853 - DNA, 27 bp, Artificial Sequence
  Description of Artificial Sequence: Synthetic oligonucleotide
ccctggtcctgtcctcttctccagcat

SEQ ID NO: 421854 - DNA, 27 bp, Artificial Sequence
  Description of Artificial Sequence: Synthetic oligonucleotide
cctggtcctgtcctcttctccagcatg

SEQ ID NO: 421855 - DNA, 27 bp, Artificial Sequence
  Description of Artificial Sequence: Synthetic oligonucleotide
ctggtcctgtcctcttctccagcatgg

SEQ ID NO: 421856 - DNA, 28 bp, Artificial Sequence
  Description of Artificial Sequence: Synthetic oligonucleotide
tggtcctgtcctcttctccagcatggtg

SEQ ID NO: 421857 - DNA, 27 bp, Artificial Sequence
  Description of Artificial Sequence: Synthetic oligonucleotide
ggtcctgtcctcttctccagcatggtg

SEQ ID NO: 421858 - DNA, 28 bp, Artificial Sequence
  Description of Artificial Sequence: Synthetic oligonucleotide
gtcctgtcctcttctccagcatggtgtg

SEQ ID NO: 421859 - DNA, 29 bp, Artificial Sequence
  Description of Artificial Sequence: Synthetic oligonucleotide
tcctgtcctcttctccagcatggtgtgtc

SEQ ID NO: 421860 - DNA, 28 bp, Artificial Sequence
  Description of Artificial Sequence: Synthetic oligonucleotide
cctgtcctcttctccagcatggtgtgtc

SEQ ID NO: 421861 - DNA, 29 bp, Artificial Sequence
  Description of Artificial Sequence: Synthetic oligonucleotide
ctgtcctcttctccagcatggtgtgtctg

SEQ ID NO: 421862 - DNA, 31 bp, Artificial Sequence
  Description of Artificial Sequence: Synthetic oligonucleotide
tgtcctcttctccagcatggtgtgtctgaag

SEQ ID NO: 421863 - DNA, 30 bp, Artificial Sequence
  Description of Artificial Sequence: Synthetic oligonucleotide
gtcctcttctccagcatggtgtgtctgaag

SEQ ID NO: 421864 - DNA, 30 bp, Artificial Sequence
  Description of Artificial Sequence: Synthetic oligonucleotide
tcctcttctccagcatggtgtgtctgaagc

SEQ ID NO: 421865 - DNA, 29 bp, Artificial Sequence
  Description of Artificial Sequence: Synthetic oligonucleotide
cctcttctccagcatggtgtgtctgaagc

SEQ ID NO: 421866 - DNA, 30 bp, Artificial Sequence
  Description of Artificial Sequence: Synthetic oligonucleotide
ctcttctccagcatggtgtgtctgaagctc

SEQ ID NO: 421867 - DNA, 30 bp, Artificial Sequence
  Description of Artificial Sequence: Synthetic oligonucleotide
tcttctccagcatggtgtgtctgaagctcc

SEQ ID NO: 421868 - DNA, 29 bp, Artificial Sequence
  Description of Artificial Sequence: Synthetic oligonucleotide
cttctccagcatggtgtgtctgaagctcc

SEQ ID NO: 421869 - DNA, 27 bp, Artificial Sequence
  Description of Artificial Sequence: Synthetic oligonucleotide
tgtgtctgaagctccctggaggctcca

SEQ ID NO: 421870 - DNA, 26 bp, Artificial Sequence
  Description of Artificial Sequence: Synthetic oligonucleotide
gtgtctgaagctccctggaggctcca

SEQ ID NO: 421871 - DNA, 26 bp, Artificial Sequence
  Description of Artificial Sequence: Synthetic oligonucleotide
tgtctgaagctccctggaggctccag

SEQ ID NO: 421872 - DNA, 25 bp, Artificial Sequence
  Description of Artificial Sequence: Synthetic oligonucleotide
gtctgaagctccctggaggctccag

SEQ ID NO: 421873 - DNA, 27 bp, Artificial Sequence
  Description of Artificial Sequence: Synthetic oligonucleotide
tctgaagctccctggaggctccagctt

SEQ ID NO: 421874 - DNA, 26 bp, Artificial Sequence
  Description of Artificial Sequence: Synthetic oligonucleotide
ctgaagctccctggaggctccagctt

SEQ ID NO: 421875 - DNA, 26 bp, Artificial Sequence
  Description of Artificial Sequence: Synthetic oligonucleotide
tgaagctccctggaggctccagcttg

SEQ ID NO: 421876 - DNA, 25 bp, Artificial Sequence
  Description of Artificial Sequence: Synthetic oligonucleotide
gaagctccctggaggctccagcttg

SEQ ID NO: 421877 - DNA, 25 bp, Artificial Sequence
  Description of Artificial Sequence: Synthetic oligonucleotide
aagctccctggaggctccagcttgg

SEQ ID NO: 421878 - DNA, 24 bp, Artificial Sequence
  Description of Artificial Sequence: Synthetic oligonucleotide
agctccctggaggctccagcttgg

SEQ ID NO: 421879 - DNA, 23 bp, Artificial Sequence
  Description of Artificial Sequence: Synthetic oligonucleotide
gctccctggaggctccagcttgg

SEQ ID NO: 421880 - DNA, 24 bp, Artificial Sequence
  Description of Artificial Sequence: Synthetic oligonucleotide
ctccctggaggctccagcttggca

SEQ ID NO: 421881 - DNA, 24 bp, Artificial Sequence
  Description of Artificial Sequence: Synthetic oligonucleotide
tccctggaggctccagcttggcag

SEQ ID NO: 421882 - DNA, 23 bp, Artificial Sequence
  Description of Artificial Sequence: Synthetic oligonucleotide
ccctggaggctccagcttggcag

SEQ ID NO: 421883 - DNA, 23 bp, Artificial Sequence
  Description of Artificial Sequence: Synthetic oligonucleotide
cctggaggctccagcttggcagc

SEQ ID NO: 421884 - DNA, 25 bp, Artificial Sequence
  Description of Artificial Sequence: Synthetic oligonucleotide
ctggaggctccagcttggcagcgtt

SEQ ID NO: 421885 - DNA, 26 bp, Artificial Sequence
  Description of Artificial Sequence: Synthetic oligonucleotide
tggaggctccagcttggcagcgttga

SEQ ID NO: 421886 - DNA, 25 bp, Artificial Sequence
  Description of Artificial Sequence: Synthetic oligonucleotide
ggaggctccagcttggcagcgttga

SEQ ID NO: 421887 - DNA, 26 bp, Artificial Sequence
  Description of Artificial Sequence: Synthetic oligonucleotide
gaggctccagcttggcagcgttgaca

SEQ ID NO: 421888 - DNA, 27 bp, Artificial Sequence
  Description of Artificial Sequence: Synthetic oligonucleotide
aggctccagcttggcagcgttgacagt

SEQ ID NO: 421889 - DNA, 26 bp, Artificial Sequence
  Description of Artificial Sequence: Synthetic oligonucleotide
ggctccagcttggcagcgttgacagt

SEQ ID NO: 421890 - DNA, 27 bp, Artificial Sequence
  Description of Artificial Sequence: Synthetic oligonucleotide
gctccagcttggcagcgttgacagtga

SEQ ID NO: 421891 - DNA, 27 bp, Artificial Sequence
  Description of Artificial Sequence: Synthetic oligonucleotide
ctccagcttggcagcgttgacagtgac

SEQ ID NO: 421892 - DNA, 28 bp, Artificial Sequence
  Description of Artificial Sequence: Synthetic oligonucleotide
tccagcttggcagcgttgacagtgacac

SEQ ID NO: 421893 - DNA, 27 bp, Artificial Sequence
  Description of Artificial Sequence: Synthetic oligonucleotide
ccagcttggcagcgttgacagtgacac

SEQ ID NO: 421894 - DNA, 28 bp, Artificial Sequence
  Description of Artificial Sequence: Synthetic oligonucleotide
cagcttggcagcgttgacagtgacactg

SEQ ID NO: 421895 - DNA, 30 bp, Artificial Sequence; identical to SEQ ID NO: 73673
  Description of Artificial Sequence: Synthetic oligonucleotide

SEQ ID NO: 421896 - DNA, 29 bp, Artificial Sequence
  Description of Artificial Sequence: Synthetic oligonucleotide
gcttggcagcgttgacagtgacactgatg

SEQ ID NO: 421897 - DNA, 29 bp, Artificial Sequence
  Description of Artificial Sequence: Synthetic oligonucleotide
cttggcagcgttgacagtgacactgatgg

SEQ ID NO: 421898 - DNA, 30 bp, Artificial Sequence; identical to SEQ ID NO: 73676
  Description of Artificial Sequence: Synthetic oligonucleotide

SEQ ID NO: 421899 - DNA, 29 bp, Artificial Sequence
  Description of Artificial Sequence: Synthetic oligonucleotide
tggcagcgttgacagtgacactgatggtg

SEQ ID NO: 421900 - DNA, 28 bp, Artificial Sequence
  Description of Artificial Sequence: Synthetic oligonucleotide
ggcagcgttgacagtgacactgatggtg

SEQ ID NO: 421901 - DNA, 28 bp, Artificial Sequence
  Description of Artificial Sequence: Synthetic oligonucleotide
gcagcgttgacagtgacactgatggtgc

SEQ ID NO: 421902 - DNA, 29 bp, Artificial Sequence
  Description of Artificial Sequence: Synthetic oligonucleotide
cagcgttgacagtgacactgatggtgctg

SEQ ID NO: 421903 - DNA, 30 bp, Artificial Sequence; identical to SEQ ID NO: 73681
  Description of Artificial Sequence: Synthetic oligonucleotide

SEQ ID NO: 421904 - DNA, 29 bp, Artificial Sequence
  Description of Artificial Sequence: Synthetic oligonucleotide
gcgttgacagtgacactgatggtgctgag

SEQ ID NO: 421905 - DNA, 29 bp, Artificial Sequence
  Description of Artificial Sequence: Synthetic oligonucleotide
cgttgacagtgacactgatggtgctgagc

SEQ ID NO: 421906 - DNA, 30 bp, Artificial Sequence; identical to SEQ ID NO: 73684
  Description of Artificial Sequence: Synthetic oligonucleotide

SEQ ID NO: 421907 - DNA, 30 bp, Artificial Sequence; identical to SEQ ID NO: 73685
  Description of Artificial Sequence: Synthetic oligonucleotide

SEQ ID NO: 421908 - DNA, 27 bp, Artificial Sequence
  Description of Artificial Sequence: Synthetic oligonucleotide
agtgacactgatggtgctgagctcccg

SEQ ID NO: 421909 - DNA, 27 bp, Artificial Sequence
  Description of Artificial Sequence: Synthetic oligonucleotide
gtgacactgatggtgctgagctcccga

SEQ ID NO: 421910 - DNA, 27 bp, Artificial Sequence
  Description of Artificial Sequence: Synthetic oligonucleotide
tgacactgatggtgctgagctcccgac

SEQ ID NO: 421911 - DNA, 27 bp, Artificial Sequence
  Description of Artificial Sequence: Synthetic oligonucleotide
gacactgatggtgctgagctcccgact

SEQ ID NO: 421912 - DNA, 27 bp, Artificial Sequence
  Description of Artificial Sequence: Synthetic oligonucleotide
acactgatggtgctgagctcccgactg

SEQ ID NO: 421913 - DNA, 26 bp, Artificial Sequence
  Description of Artificial Sequence: Synthetic oligonucleotide
cactgatggtgctgagctcccgactg

SEQ ID NO: 421914 - DNA, 26 bp, Artificial Sequence
  Description of Artificial Sequence: Synthetic oligonucleotide
actgatggtgctgagctcccgactgg

SEQ ID NO: 421915 - DNA, 25 bp, Artificial Sequence
  Description of Artificial Sequence: Synthetic oligonucleotide
ctgatggtgctgagctcccgactgg

SEQ ID NO: 421916 - DNA, 27 bp, Artificial Sequence
  Description of Artificial Sequence: Synthetic oligonucleotide
tgatggtgctgagctcccgactggctt

SEQ ID NO: 421917 - DNA, 27 bp, Artificial Sequence
  Description of Artificial Sequence: Synthetic oligonucleotide
gatggtgctgagctcccgactggcttt

SEQ ID NO: 421918 - DNA, 27 bp, Artificial Sequence
  Description of Artificial Sequence: Synthetic oligonucleotide
atggtgctgagctcccgactggctttc

SEQ ID NO: 421919 - DNA, 26 bp, Artificial Sequence
  Description of Artificial Sequence: Synthetic oligonucleotide
tggtgctgagctcccgactggctttc

SEQ ID NO: 421920 - DNA, 25 bp, Artificial Sequence
  Description of Artificial Sequence: Synthetic oligonucleotide
ggtgctgagctcccgactggctttc

SEQ ID NO: 421921 - DNA, 25 bp, Artificial Sequence
  Description of Artificial Sequence: Synthetic oligonucleotide
gtgctgagctcccgactggctttcg

SEQ ID NO: 421922 - DNA, 26 bp, Artificial Sequence
  Description of Artificial Sequence: Synthetic oligonucleotide
tgctgagctcccgactggctttcgct

SEQ ID NO: 421923 - DNA, 25 bp, Artificial Sequence
  Description of Artificial Sequence: Synthetic oligonucleotide
gctgagctcccgactggctttcgct

SEQ ID NO: 421924 - DNA, 25 bp, Artificial Sequence
  Description of Artificial Sequence: Synthetic oligonucleotide
ctgagctcccgactggctttcgctg

SEQ ID NO: 421925 - DNA, 25 bp, Artificial Sequence
  Description of Artificial Sequence: Synthetic oligonucleotide
tgagctcccgactggctttcgctgg

SEQ ID NO: 421926 - DNA, 24 bp, Artificial Sequence
  Description of Artificial Sequence: Synthetic oligonucleotide
gagctcccgactggctttcgctgg

SEQ ID NO: 421927 - DNA, 24 bp, Artificial Sequence
  Description of Artificial Sequence: Synthetic oligonucleotide
agctcccgactggctttcgctggg

SEQ ID NO: 421928 - DNA, 23 bp, Artificial Sequence
  Description of Artificial Sequence: Synthetic oligonucleotide
gctcccgactggctttcgctggg

SEQ ID NO: 421929 - DNA, 24 bp, Artificial Sequence
  Description of Artificial Sequence: Synthetic oligonucleotide
ctcccgactggctttcgctgggga

SEQ ID NO: 421930 - DNA, 25 bp, Artificial Sequence
  Description of Artificial Sequence: Synthetic oligonucleotide
tcccgactggctttcgctggggaca

SEQ ID NO: 421931 - DNA, 24 bp, Artificial Sequence
  Description of Artificial Sequence: Synthetic oligonucleotide
cccgactggctttcgctggggaca

SEQ ID NO: 421932 - DNA, 24 bp, Artificial Sequence
  Description of Artificial Sequence: Synthetic oligonucleotide
ccgactggctttcgctggggacac

SEQ ID NO: 421933 - DNA, 24 bp, Artificial Sequence
  Description of Artificial Sequence: Synthetic oligonucleotide
cgactggctttcgctggggacacc

SEQ ID NO: 421934 - DNA, 24 bp, Artificial Sequence
  Description of Artificial Sequence: Synthetic oligonucleotide
gactggctttcgctggggacaccc

SEQ ID NO: 421935 - DNA, 25 bp, Artificial Sequence
  Description of Artificial Sequence: Synthetic oligonucleotide
actggctttcgctggggacacccga

SEQ ID NO: 421936 - DNA, 24 bp, Artificial Sequence
  Description of Artificial Sequence: Synthetic oligonucleotide
ctggctttcgctggggacacccga

SEQ ID NO: 421937 - DNA, 24 bp, Artificial Sequence
  Description of Artificial Sequence: Synthetic oligonucleotide
tggctttcgctggggacacccgac

SEQ ID NO: 421938 - DNA, 23 bp, Artificial Sequence
  Description of Artificial Sequence: Synthetic oligonucleotide
ggctttcgctggggacacccgac

SEQ ID NO: 421939 - DNA, 24 bp, Artificial Sequence
  Description of Artificial Sequence: Synthetic oligonucleotide
gctttcgctggggacacccgacca

SEQ ID NO: 421940 - DNA, 24 bp, Artificial Sequence
  Description of Artificial Sequence: Synthetic oligonucleotide
ctttcgctggggacacccgaccac

SEQ ID NO: 421941 - DNA, 27 bp, Artificial Sequence
  Description of Artificial Sequence: Synthetic oligonucleotide
tttcgctggggacacccgaccacgttt

SEQ ID NO: 421942 - DNA, 26 bp, Artificial Sequence
  Description of Artificial Sequence: Synthetic oligonucleotide
ttcgctggggacacccgaccacgttt

SEQ ID NO: 421943 - DNA, 25 bp, Artificial Sequence
  Description of Artificial Sequence: Synthetic oligonucleotide
tcgctggggacacccgaccacgttt

SEQ ID NO: 421944 - DNA, 24 bp, Artificial Sequence
  Description of Artificial Sequence: Synthetic oligonucleotide
cgctggggacacccgaccacgttt

SEQ ID NO: 421945 - DNA, 27 bp, Artificial Sequence
  Description of Artificial Sequence: Synthetic oligonucleotide
ggacacccgaccacgtttcttggagct

SEQ ID NO: 421946 - DNA, 27 bp, Artificial Sequence
  Description of Artificial Sequence: Synthetic oligonucleotide
gacacccgaccacgtttcttggagctg

SEQ ID NO: 421947 - DNA, 27 bp, Artificial Sequence
  Description of Artificial Sequence: Synthetic oligonucleotide
acacccgaccacgtttcttggagctgc

SEQ ID NO: 421948 - DNA, 26 bp, Artificial Sequence
  Description of Artificial Sequence: Synthetic oligonucleotide
cacccgaccacgtttcttggagctgc

SEQ ID NO: 421949 - DNA, 27 bp, Artificial Sequence
  Description of Artificial Sequence: Synthetic oligonucleotide
acccgaccacgtttcttggagctgcgt

SEQ ID NO: 421950 - DNA, 27 bp, Artificial Sequence
  Description of Artificial Sequence: Synthetic oligonucleotide
cccgaccacgtttcttggagctgcgta

SEQ ID NO: 421951 - DNA, 28 bp, Artificial Sequence
  Description of Artificial Sequence: Synthetic oligonucleotide
ccgaccacgtttcttggagctgcgtaag

SEQ ID NO: 421952 - DNA, 29 bp, Artificial Sequence
  Description of Artificial Sequence: Synthetic oligonucleotide
cgaccacgtttcttggagctgcgtaagtc

SEQ ID NO: 421953 - DNA, 26 bp, Artificial Sequence
  Description of Artificial Sequence: Synthetic oligonucleotide
acagtgcagcggcgagtccatcctca

SEQ ID NO: 421954 - DNA, 25 bp, Artificial Sequence
  Description of Artificial Sequence: Synthetic oligonucleotide
cagtgcagcggcgagtccatcctca

SEQ ID NO: 421955 - DNA, 25 bp, Artificial Sequence
  Description of Artificial Sequence: Synthetic oligonucleotide
agtgcagcggcgagtccatcctcag

SEQ ID NO: 421956 - DNA, 24 bp, Artificial Sequence
  Description of Artificial Sequence: Synthetic oligonucleotide
gtgcagcggcgagtccatcctcag

SEQ ID NO: 421957 - DNA, 25 bp, Artificial Sequence
  Description of Artificial Sequence: Synthetic oligonucleotide
tgcagcggcgagtccatcctcaggt

SEQ ID NO: 421958 - DNA, 24 bp, Artificial Sequence
  Description of Artificial Sequence: Synthetic oligonucleotide
gcagcggcgagtccatcctcaggt

SEQ ID NO: 421959 - DNA, 25 bp, Artificial Sequence
  Description of Artificial Sequence: Synthetic oligonucleotide
cagcggcgagtccatcctcaggtga

SEQ ID NO: 421960 - DNA, 26 bp, Artificial Sequence
  Description of Artificial Sequence: Synthetic oligonucleotide
agcggcgagtccatcctcaggtgact

SEQ ID NO: 421961 - DNA, 25 bp, Artificial Sequence
  Description of Artificial Sequence: Synthetic oligonucleotide
gcggcgagtccatcctcaggtgact

SEQ ID NO: 421962 - DNA, 26 bp, Artificial Sequence
  Description of Artificial Sequence: Synthetic oligonucleotide
cggcgagtccatcctcaggtgactgt

SEQ ID NO: 421963 - DNA, 27 bp, Artificial Sequence
  Description of Artificial Sequence: Synthetic oligonucleotide
ggcgagtccatcctcaggtgactgtgt

SEQ ID NO: 421964 - DNA, 29 bp, Artificial Sequence
  Description of Artificial Sequence: Synthetic oligonucleotide
gcgagtccatcctcaggtgactgtgtatc

SEQ ID NO: 421965 - DNA, 29 bp, Artificial Sequence
  Description of Artificial Sequence: Synthetic oligonucleotide
cgagtccatcctcaggtgactgtgtatcc

SEQ ID NO: 421966 - DNA, 30 bp, Artificial Sequence; identical to SEQ ID NO: 73744
  Description of Artificial Sequence: Synthetic oligonucleotide

SEQ ID NO: 421967 - DNA, 30 bp, Artificial Sequence; identical to SEQ ID NO: 73745
  Description of Artificial Sequence: Synthetic oligonucleotide

SEQ ID NO: 421968 - DNA, 29 bp, Artificial Sequence
  Description of Artificial Sequence: Synthetic oligonucleotide
gtccatcctcaggtgactgtgtatcctgc

SEQ ID NO: 421969 - DNA, 32 bp, Artificial Sequence; identical to SEQ ID NO: 73747
  Description of Artificial Sequence: Synthetic oligonucleotide

SEQ ID NO: 421970 - DNA, 31 bp, Artificial Sequence; identical to SEQ ID NO: 73748
  Description of Artificial Sequence: Synthetic oligonucleotide

SEQ ID NO: 421971 - DNA, 32 bp, Artificial Sequence; identical to SEQ ID NO: 73749
  Description of Artificial Sequence: Synthetic oligonucleotide

SEQ ID NO: 421972 - DNA, 32 bp, Artificial Sequence; identical to SEQ ID NO: 73750
  Description of Artificial Sequence: Synthetic oligonucleotide

SEQ ID NO: 421973 - DNA, 31 bp, Artificial Sequence; identical to SEQ ID NO: 73751
  Description of Artificial Sequence: Synthetic oligonucleotide

SEQ ID NO: 421974 - DNA, 30 bp, Artificial Sequence; identical to SEQ ID NO: 73752
  Description of Artificial Sequence: Synthetic oligonucleotide

SEQ ID NO: 421975 - DNA, 30 bp, Artificial Sequence; identical to SEQ ID NO: 73753
  Description of Artificial Sequence: Synthetic oligonucleotide

SEQ ID NO: 421976 - DNA, 31 bp, Artificial Sequence; identical to SEQ ID NO: 73754
  Description of Artificial Sequence: Synthetic oligonucleotide

SEQ ID NO: 421977 - DNA, 30 bp, Artificial Sequence; identical to SEQ ID NO: 73755
  Description of Artificial Sequence: Synthetic oligonucleotide

SEQ ID NO: 421978 - DNA, 26 bp, Artificial Sequence
  Description of Artificial Sequence: Synthetic oligonucleotide
gaagagaaggctggggtggtgtccac

SEQ ID NO: 421979 - DNA, 26 bp, Artificial Sequence
  Description of Artificial Sequence: Synthetic oligonucleotide
aagagaaggctggggtggtgtccacg

SEQ ID NO: 421980 - DNA, 25 bp, Artificial Sequence
  Description of Artificial Sequence: Synthetic oligonucleotide
agagaaggctggggtggtgtccacg

SEQ ID NO: 421981 - DNA, 24 bp, Artificial Sequence
  Description of Artificial Sequence: Synthetic oligonucleotide
gagaaggctggggtggtgtccacg

SEQ ID NO: 421982 - DNA, 24 bp, Artificial Sequence
  Description of Artificial Sequence: Synthetic oligonucleotide
agaaggctggggtggtgtccacgg

SEQ ID NO: 421983 - DNA, 23 bp, Artificial Sequence
  Description of Artificial Sequence: Synthetic oligonucleotide
gaaggctggggtggtgtccacgg

SEQ ID NO: 421984 - DNA, 23 bp, Artificial Sequence
  Description of Artificial Sequence: Synthetic oligonucleotide
aaggctggggtggtgtccacggg

SEQ ID NO: 421985 - DNA, 22 bp, Artificial Sequence
  Description of Artificial Sequence: Synthetic oligonucleotide
aggctggggtggtgtccacggg

SEQ ID NO: 421986 - DNA, 21 bp, Artificial Sequence
  Description of Artificial Sequence: Synthetic oligonucleotide
ggctggggtggtgtccacggg

SEQ ID NO: 421987 - DNA, 21 bp, Artificial Sequence
  Description of Artificial Sequence: Synthetic oligonucleotide
gctggggtggtgtccacgggc

SEQ ID NO: 421988 - DNA, 28 bp, Artificial Sequence
  Description of Artificial Sequence: Synthetic oligonucleotide
tggaccttccagaccctggtgatgctag

SEQ ID NO: 421989 - DNA, 27 bp, Artificial Sequence
  Description of Artificial Sequence: Synthetic oligonucleotide
ggaccttccagaccctggtgatgctag

SEQ ID NO: 421990 - DNA, 30 bp, Artificial Sequence; identical to SEQ ID NO: 73768
  Description of Artificial Sequence: Synthetic oligonucleotide

SEQ ID NO: 421991 - DNA, 31 bp, Artificial Sequence; identical to SEQ ID NO: 73769
  Description of Artificial Sequence: Synthetic oligonucleotide

SEQ ID NO: 421992 - DNA, 30 bp, Artificial Sequence; identical to SEQ ID NO: 73770
  Description of Artificial Sequence: Synthetic oligonucleotide

SEQ ID NO: 421993 - DNA, 32 bp, Artificial Sequence; identical to SEQ ID NO: 73771
  Description of Artificial Sequence: Synthetic oligonucleotide

SEQ ID NO: 421994 - DNA, 32 bp, Artificial Sequence; identical to SEQ ID NO: 73772
  Description of Artificial Sequence: Synthetic oligonucleotide

SEQ ID NO: 421995 - DNA, 31 bp, Artificial Sequence; identical to SEQ ID NO: 73773
  Description of Artificial Sequence: Synthetic oligonucleotide

SEQ ID NO: 421996 - DNA, 30 bp, Artificial Sequence; identical to SEQ ID NO: 73774
  Description of Artificial Sequence: Synthetic oligonucleotide

SEQ ID NO: 421997 - DNA, 31 bp, Artificial Sequence; identical to SEQ ID NO: 73775
  Description of Artificial Sequence: Synthetic oligonucleotide

SEQ ID NO: 421998 - DNA, 31 bp, Artificial Sequence; identical to SEQ ID NO: 73776
  Description of Artificial Sequence: Synthetic oligonucleotide

SEQ ID NO: 421999 - DNA, 30 bp, Artificial Sequence; identical to SEQ ID NO: 73777
  Description of Artificial Sequence: Synthetic oligonucleotide

SEQ ID NO: 422000 - DNA, 30 bp, Artificial Sequence; identical to SEQ ID NO: 73778
  Description of Artificial Sequence: Synthetic oligonucleotide

SEQ ID NO: 422001 - DNA, 29 bp, Artificial Sequence
  Description of Artificial Sequence: Synthetic oligonucleotide
ccctggtgatgctagaaacagttcctcgg

SEQ ID NO: 422002 - DNA, 30 bp, Artificial Sequence; identical to SEQ ID NO: 73780
  Description of Artificial Sequence: Synthetic oligonucleotide

SEQ ID NO: 422003 - DNA, 31 bp, Artificial Sequence; identical to SEQ ID NO: 73781
  Description of Artificial Sequence: Synthetic oligonucleotide

SEQ ID NO: 422004 - DNA, 31 bp, Artificial Sequence; identical to SEQ ID NO: 73782
  Description of Artificial Sequence: Synthetic oligonucleotide

SEQ ID NO: 422005 - DNA, 30 bp, Artificial Sequence; identical to SEQ ID NO: 73783
  Description of Artificial Sequence: Synthetic oligonucleotide

SEQ ID NO: 422006 - DNA, 31 bp, Artificial Sequence; identical to SEQ ID NO: 73784
  Description of Artificial Sequence: Synthetic oligonucleotide

SEQ ID NO: 422007 - DNA, 32 bp, Artificial Sequence; identical to SEQ ID NO: 73785
  Description of Artificial Sequence: Synthetic oligonucleotide

SEQ ID NO: 422008 - DNA, 31 bp, Artificial Sequence; identical to SEQ ID NO: 73786
  Description of Artificial Sequence: Synthetic oligonucleotide

SEQ ID NO: 422009 - DNA, 31 bp, Artificial Sequence; identical to SEQ ID NO: 73787
  Description of Artificial Sequence: Synthetic oligonucleotide

SEQ ID NO: 422010 - DNA, 30 bp, Artificial Sequence; identical to SEQ ID NO: 73788
  Description of Artificial Sequence: Synthetic oligonucleotide

SEQ ID NO: 422011 - DNA, 29 bp, Artificial Sequence
  Description of Artificial Sequence: Synthetic oligonucleotide
gctagaaacagttcctcggagtggagagg

SEQ ID NO: 422012 - DNA, 33 bp, Artificial Sequence; identical to SEQ ID NO: 73790
  Description of Artificial Sequence: Synthetic oligonucleotide

SEQ ID NO: 422013 - DNA, 34 bp, Artificial Sequence; identical to SEQ ID NO: 73791
  Description of Artificial Sequence: Synthetic oligonucleotide

SEQ ID NO: 422014 - DNA, 33 bp, Artificial Sequence; identical to SEQ ID NO: 73792
  Description of Artificial Sequence: Synthetic oligonucleotide

SEQ ID NO: 422015 - DNA, 34 bp, Artificial Sequence; identical to SEQ ID NO: 73793
  Description of Artificial Sequence: Synthetic oligonucleotide

SEQ ID NO: 422016 - DNA, 33 bp, Artificial Sequence; identical to SEQ ID NO: 73794
  Description of Artificial Sequence: Synthetic oligonucleotide

SEQ ID NO: 422017 - DNA, 32 bp, Artificial Sequence; identical to SEQ ID NO: 73795
  Description of Artificial Sequence: Synthetic oligonucleotide

SEQ ID NO: 422018 - DNA, 31 bp, Artificial Sequence; identical to SEQ ID NO: 73796
  Description of Artificial Sequence: Synthetic oligonucleotide

SEQ ID NO: 422019 - DNA, 31 bp, Artificial Sequence; identical to SEQ ID NO: 73797
  Description of Artificial Sequence: Synthetic oligonucleotide

SEQ ID NO: 422020 - DNA, 30 bp, Artificial Sequence; identical to SEQ ID NO: 73798
  Description of Artificial Sequence: Synthetic oligonucleotide

SEQ ID NO: 422021 - DNA, 30 bp, Artificial Sequence; identical to SEQ ID NO: 73799
  Description of Artificial Sequence: Synthetic oligonucleotide

SEQ ID NO: 422022 - DNA, 29 bp, Artificial Sequence
  Description of Artificial Sequence: Synthetic oligonucleotide
tcctcggagtggagaggtttacacttgcc

SEQ ID NO: 422023 - DNA, 28 bp, Artificial Sequence
  Description of Artificial Sequence: Synthetic oligonucleotide
cctcggagtggagaggtttacacttgcc

SEQ ID NO: 422024 - DNA, 30 bp, Artificial Sequence; identical to SEQ ID NO: 73802
  Description of Artificial Sequence: Synthetic oligonucleotide

SEQ ID NO: 422025 - DNA, 31 bp, Artificial Sequence; identical to SEQ ID NO: 73803
  Description of Artificial Sequence: Synthetic oligonucleotide

SEQ ID NO: 422026 - DNA, 30 bp, Artificial Sequence; identical to SEQ ID NO: 73804
  Description of Artificial Sequence: Synthetic oligonucleotide

SEQ ID NO: 422027 - DNA, 30 bp, Artificial Sequence; identical to SEQ ID NO: 73805
  Description of Artificial Sequence: Synthetic oligonucleotide

SEQ ID NO: 422028 - DNA, 31 bp, Artificial Sequence; identical to SEQ ID NO: 73806
  Description of Artificial Sequence: Synthetic oligonucleotide

SEQ ID NO: 422029 - DNA, 31 bp, Artificial Sequence; identical to SEQ ID NO: 73807
  Description of Artificial Sequence: Synthetic oligonucleotide

SEQ ID NO: 422030 - DNA, 30 bp, Artificial Sequence; identical to SEQ ID NO: 73808
  Description of Artificial Sequence: Synthetic oligonucleotide

SEQ ID NO: 422031 - DNA, 31 bp, Artificial Sequence; identical to SEQ ID NO: 73809
  Description of Artificial Sequence: Synthetic oligonucleotide

SEQ ID NO: 422032 - DNA, 30 bp, Artificial Sequence; identical to SEQ ID NO: 73810
  Description of Artificial Sequence: Synthetic oligonucleotide

SEQ ID NO: 422033 - DNA, 30 bp, Artificial Sequence; identical to SEQ ID NO: 73811
  Description of Artificial Sequence: Synthetic oligonucleotide

SEQ ID NO: 422034 - DNA, 30 bp, Artificial Sequence; identical to SEQ ID NO: 73812
  Description of Artificial Sequence: Synthetic oligonucleotide

SEQ ID NO: 422035 - DNA, 29 bp, Artificial Sequence
  Description of Artificial Sequence: Synthetic oligonucleotide
gaggtttacacttgccaagtggagcaccc

SEQ ID NO: 422036 - DNA, 31 bp, Artificial Sequence; identical to SEQ ID NO: 73814
  Description of Artificial Sequence: Synthetic oligonucleotide

SEQ ID NO: 422037 - DNA, 30 bp, Artificial Sequence; identical to SEQ ID NO: 73815
  Description of Artificial Sequence: Synthetic oligonucleotide

SEQ ID NO: 422038 - DNA, 30 bp, Artificial Sequence; identical to SEQ ID NO: 73816
  Description of Artificial Sequence: Synthetic oligonucleotide

SEQ ID NO: 422039 - DNA, 30 bp, Artificial Sequence; identical to SEQ ID NO: 73817
  Description of Artificial Sequence: Synthetic oligonucleotide

SEQ ID NO: 422040 - DNA, 29 bp, Artificial Sequence
  Description of Artificial Sequence: Synthetic oligonucleotide
ttacacttgccaagtggagcacccaagcg

SEQ ID NO: 422041 - DNA, 28 bp, Artificial Sequence
  Description of Artificial Sequence: Synthetic oligonucleotide
tacacttgccaagtggagcacccaagcg

SEQ ID NO: 422042 - DNA, 27 bp, Artificial Sequence
  Description of Artificial Sequence: Synthetic oligonucleotide
acacttgccaagtggagcacccaagcg

SEQ ID NO: 422043 - DNA, 27 bp, Artificial Sequence
  Description of Artificial Sequence: Synthetic oligonucleotide
cacttgccaagtggagcacccaagcgt

SEQ ID NO: 422044 - DNA, 29 bp, Artificial Sequence
  Description of Artificial Sequence: Synthetic oligonucleotide
acttgccaagtggagcacccaagcgtaac

SEQ ID NO: 422045 - DNA, 28 bp, Artificial Sequence
  Description of Artificial Sequence: Synthetic oligonucleotide
cttgccaagtggagcacccaagcgtaac

SEQ ID NO: 422046 - DNA, 28 bp, Artificial Sequence
  Description of Artificial Sequence: Synthetic oligonucleotide
ttgccaagtggagcacccaagcgtaacg

SEQ ID NO: 422047 - DNA, 27 bp, Artificial Sequence
  Description of Artificial Sequence: Synthetic oligonucleotide
tgccaagtggagcacccaagcgtaacg

SEQ ID NO: 422048 - DNA, 27 bp, Artificial Sequence
  Description of Artificial Sequence: Synthetic oligonucleotide
gccaagtggagcacccaagcgtaacga

SEQ ID NO: 422049 - DNA, 27 bp, Artificial Sequence
  Description of Artificial Sequence: Synthetic oligonucleotide
ccaagtggagcacccaagcgtaacgag

SEQ ID NO: 422050 - DNA, 27 bp, Artificial Sequence
  Description of Artificial Sequence: Synthetic oligonucleotide
caagtggagcacccaagcgtaacgagc

SEQ ID NO: 422051 - DNA, 27 bp, Artificial Sequence
  Description of Artificial Sequence: Synthetic oligonucleotide
aagtggagcacccaagcgtaacgagcg

SEQ ID NO: 422052 - DNA, 26 bp, Artificial Sequence
  Description of Artificial Sequence: Synthetic oligonucleotide
agtggagcacccaagcgtaacgagcg

SEQ ID NO: 422053 - DNA, 25 bp, Artificial Sequence
  Description of Artificial Sequence: Synthetic oligonucleotide
gtggagcacccaagcgtaacgagcg

SEQ ID NO: 422054 - DNA, 26 bp, Artificial Sequence
  Description of Artificial Sequence: Synthetic oligonucleotide
tggagcacccaagcgtaacgagcgct

SEQ ID NO: 422055 - DNA, 25 bp, Artificial Sequence
  Description of Artificial Sequence: Synthetic oligonucleotide
ggagcacccaagcgtaacgagcgct

SEQ ID NO: 422056 - DNA, 26 bp, Artificial Sequence
  Description of Artificial Sequence: Synthetic oligonucleotide
gagcacccaagcgtaacgagcgctct

SEQ ID NO: 422057 - DNA, 27 bp, Artificial Sequence
  Description of Artificial Sequence: Synthetic oligonucleotide
agcacccaagcgtaacgagcgctctca

SEQ ID NO: 422058 - DNA, 26 bp, Artificial Sequence
  Description of Artificial Sequence: Synthetic oligonucleotide
gcacccaagcgtaacgagcgctctca

SEQ ID NO: 422059 - DNA, 27 bp, Artificial Sequence
  Description of Artificial Sequence: Synthetic oligonucleotide
cacccaagcgtaacgagcgctctcaca

SEQ ID NO: 422060 - DNA, 27 bp, Artificial Sequence
  Description of Artificial Sequence: Synthetic oligonucleotide
acccaagcgtaacgagcgctctcacag

SEQ ID NO: 422061 - DNA, 27 bp, Artificial Sequence
  Description of Artificial Sequence: Synthetic oligonucleotide
cccaagcgtaacgagcgctctcacagt

SEQ ID NO: 422062 - DNA, 27 bp, Artificial Sequence
  Description of Artificial Sequence: Synthetic oligonucleotide
ccaagcgtaacgagcgctctcacagtg

SEQ ID NO: 422063 - DNA, 27 bp, Artificial Sequence
  Description of Artificial Sequence: Synthetic oligonucleotide
caagcgtaacgagcgctctcacagtgg

SEQ ID NO: 422064 - DNA, 30 bp, Artificial Sequence; identical to SEQ ID NO: 73842
  Description of Artificial Sequence: Synthetic oligonucleotide

SEQ ID NO: 422065 - DNA, 29 bp, Artificial Sequence
  Description of Artificial Sequence: Synthetic oligonucleotide
agcgtaacgagcgctctcacagtggaatg

SEQ ID NO: 422066 - DNA, 28 bp, Artificial Sequence
  Description of Artificial Sequence: Synthetic oligonucleotide
gcgtaacgagcgctctcacagtggaatg

SEQ ID NO: 422067 - DNA, 28 bp, Artificial Sequence
  Description of Artificial Sequence: Synthetic oligonucleotide
cgtaacgagcgctctcacagtggaatgg

SEQ ID NO: 422068 - DNA, 29 bp, Artificial Sequence
  Description of Artificial Sequence: Synthetic oligonucleotide
gtaacgagcgctctcacagtggaatggag

SEQ ID NO: 422069 - DNA, 30 bp, Artificial Sequence; identical to SEQ ID NO: 73847
  Description of Artificial Sequence: Synthetic oligonucleotide

SEQ ID NO: 422070 - DNA, 29 bp, Artificial Sequence
  Description of Artificial Sequence: Synthetic oligonucleotide
aacgagcgctctcacagtggaatggagag

SEQ ID NO: 422071 - DNA, 28 bp, Artificial Sequence
  Description of Artificial Sequence: Synthetic oligonucleotide
acgagcgctctcacagtggaatggagag

SEQ ID NO: 422072 - DNA, 27 bp, Artificial Sequence
  Description of Artificial Sequence: Synthetic oligonucleotide
cgagcgctctcacagtggaatggagag

SEQ ID NO: 422073 - DNA, 27 bp, Artificial Sequence
  Description of Artificial Sequence: Synthetic oligonucleotide
gagcgctctcacagtggaatggagagc

SEQ ID NO: 422074 - DNA, 28 bp, Artificial Sequence
  Description of Artificial Sequence: Synthetic oligonucleotide
agcgctctcacagtggaatggagagcac

SEQ ID NO: 422075 - DNA, 27 bp, Artificial Sequence
  Description of Artificial Sequence: Synthetic oligonucleotide
gcgctctcacagtggaatggagagcac

SEQ ID NO: 422076 - DNA, 27 bp, Artificial Sequence
  Description of Artificial Sequence: Synthetic oligonucleotide
cgctctcacagtggaatggagagcacg

SEQ ID NO: 422077 - DNA, 27 bp, Artificial Sequence
  Description of Artificial Sequence: Synthetic oligonucleotide
gctctcacagtggaatggagagcacgg

SEQ ID NO: 422078 - DNA, 22 bp, Artificial Sequence
  Description of Artificial Sequence: Synthetic oligonucleotide
ctggggcggcctgttgccgagt

SEQ ID NO: 422079 - DNA, 22 bp, Artificial Sequence
  Description of Artificial Sequence: Synthetic oligonucleotide
tggggcggcctgttgccgagtc

SEQ ID NO: 422080 - DNA, 21 bp, Artificial Sequence
  Description of Artificial Sequence: Synthetic oligonucleotide
ggggcggcctgttgccgagtc

SEQ ID NO: 422081 - DNA, 22 bp, Artificial Sequence
  Description of Artificial Sequence: Synthetic oligonucleotide
gggcggcctgttgccgagtcct

SEQ ID NO: 422082 - DNA, 22 bp, Artificial Sequence
  Description of Artificial Sequence: Synthetic oligonucleotide
ggcggcctgttgccgagtcctg

SEQ ID NO: 422083 - DNA, 24 bp, Artificial Sequence
  Description of Artificial Sequence: Synthetic oligonucleotide
gcggcctgttgccgagtcctggaa

SEQ ID NO: 422084 - DNA, 25 bp, Artificial Sequence
  Description of Artificial Sequence: Synthetic oligonucleotide
cggcctgttgccgagtcctggaaca

SEQ ID NO: 422085 - DNA, 25 bp, Artificial Sequence
  Description of Artificial Sequence: Synthetic oligonucleotide
ggcctgttgccgagtcctggaacag

SEQ ID NO: 422086 - DNA, 25 bp, Artificial Sequence
  Description of Artificial Sequence: Synthetic oligonucleotide
gcctgttgccgagtcctggaacagc

SEQ ID NO: 422087 - DNA, 26 bp, Artificial Sequence
  Description of Artificial Sequence: Synthetic oligonucleotide
cctgttgccgagtcctggaacagcca

SEQ ID NO: 422088 - DNA, 27 bp, Artificial Sequence
  Description of Artificial Sequence: Synthetic oligonucleotide
ctgttgccgagtcctggaacagccaga

SEQ ID NO: 422089 - DNA, 28 bp, Artificial Sequence
  Description of Artificial Sequence: Synthetic oligonucleotide
tgttgccgagtcctggaacagccagaag

SEQ ID NO: 422090 - DNA, 27 bp, Artificial Sequence
  Description of Artificial Sequence: Synthetic oligonucleotide
gttgccgagtcctggaacagccagaag

SEQ ID NO: 422091 - DNA, 27 bp, Artificial Sequence
  Description of Artificial Sequence: Synthetic oligonucleotide
ttgccgagtcctggaacagccagaagg

SEQ ID NO: 422092 - DNA, 32 bp, Artificial Sequence; identical to SEQ ID NO: 73870
  Description of Artificial Sequence: Synthetic oligonucleotide

SEQ ID NO: 422093 - DNA, 34 bp, Artificial Sequence; identical to SEQ ID NO: 73871
  Description of Artificial Sequence: Synthetic oligonucleotide

SEQ ID NO: 422094 - DNA, 34 bp, Artificial Sequence; identical to SEQ ID NO: 73872
  Description of Artificial Sequence: Synthetic oligonucleotide

SEQ ID NO: 422095 - DNA, 33 bp, Artificial Sequence; identical to SEQ ID NO: 73873
  Description of Artificial Sequence: Synthetic oligonucleotide

SEQ ID NO: 422096 - DNA, 34 bp, Artificial Sequence; identical to SEQ ID NO: 73874
  Description of Artificial Sequence: Synthetic oligonucleotide

SEQ ID NO: 422097 - DNA, 28 bp, Artificial Sequence
  Description of Artificial Sequence: Synthetic oligonucleotide
cgggtgcggtacctggacagatactttc

SEQ ID NO: 422098 - DNA, 32 bp, Artificial Sequence; identical to SEQ ID NO: 73876
  Description of Artificial Sequence: Synthetic oligonucleotide

SEQ ID NO: 422099 - DNA, 32 bp, Artificial Sequence; identical to SEQ ID NO: 73877
  Description of Artificial Sequence: Synthetic oligonucleotide

SEQ ID NO: 422100 - DNA, 33 bp, Artificial Sequence; identical to SEQ ID NO: 73878
  Description of Artificial Sequence: Synthetic oligonucleotide

SEQ ID NO: 422101 - DNA, 33 bp, Artificial Sequence; identical to SEQ ID NO: 73879
  Description of Artificial Sequence: Synthetic oligonucleotide

SEQ ID NO: 422102 - DNA, 32 bp, Artificial Sequence; identical to SEQ ID NO: 73880
  Description of Artificial Sequence: Synthetic oligonucleotide

SEQ ID NO: 422103 - DNA, 33 bp, Artificial Sequence; identical to SEQ ID NO: 73881
  Description of Artificial Sequence: Synthetic oligonucleotide

SEQ ID NO: 422104 - DNA, 33 bp, Artificial Sequence; identical to SEQ ID NO: 73882
  Description of Artificial Sequence: Synthetic oligonucleotide

SEQ ID NO: 422105 - DNA, 34 bp, Artificial Sequence; identical to SEQ ID NO: 73883
  Description of Artificial Sequence: Synthetic oligonucleotide

SEQ ID NO: 422106 - DNA, 36 bp, Artificial Sequence; identical to SEQ ID NO: 73884
  Description of Artificial Sequence: Synthetic oligonucleotide

SEQ ID NO: 422107 - DNA, 35 bp, Artificial Sequence; identical to SEQ ID NO: 73885
  Description of Artificial Sequence: Synthetic oligonucleotide

SEQ ID NO: 422108 - DNA, 34 bp, Artificial Sequence; identical to SEQ ID NO: 73886
  Description of Artificial Sequence: Synthetic oligonucleotide

SEQ ID NO: 422109 - DNA, 34 bp, Artificial Sequence; identical to SEQ ID NO: 73887
  Description of Artificial Sequence: Synthetic oligonucleotide

SEQ ID NO: 422110 - DNA, 35 bp, Artificial Sequence; identical to SEQ ID NO: 73888
  Description of Artificial Sequence: Synthetic oligonucleotide

SEQ ID NO: 422111 - DNA, 34 bp, Artificial Sequence; identical to SEQ ID NO: 73889
  Description of Artificial Sequence: Synthetic oligonucleotide

SEQ ID NO: 422112 - DNA, 34 bp, Artificial Sequence; identical to SEQ ID NO: 73890
  Description of Artificial Sequence: Synthetic oligonucleotide

SEQ ID NO: 422113 - DNA, 34 bp, Artificial Sequence; identical to SEQ ID NO: 73891
  Description of Artificial Sequence: Synthetic oligonucleotide

SEQ ID NO: 422114 - DNA, 33 bp, Artificial Sequence; identical to SEQ ID NO: 73892
  Description of Artificial Sequence: Synthetic oligonucleotide

SEQ ID NO: 422115 - DNA, 33 bp, Artificial Sequence; identical to SEQ ID NO: 73893
  Description of Artificial Sequence: Synthetic oligonucleotide

SEQ ID NO: 422116 - DNA, 32 bp, Artificial Sequence; identical to SEQ ID NO: 73894
  Description of Artificial Sequence: Synthetic oligonucleotide

SEQ ID NO: 422117 - DNA, 34 bp, Artificial Sequence; identical to SEQ ID NO: 73895
  Description of Artificial Sequence: Synthetic oligonucleotide

SEQ ID NO: 422118 - DNA, 33 bp, Artificial Sequence; identical to SEQ ID NO: 73896
  Description of Artificial Sequence: Synthetic oligonucleotide

SEQ ID NO: 422119 - DNA, 32 bp, Artificial Sequence; identical to SEQ ID NO: 73897
  Description of Artificial Sequence: Synthetic oligonucleotide

SEQ ID NO: 422120 - DNA, 31 bp, Artificial Sequence; identical to SEQ ID NO: 73898
  Description of Artificial Sequence: Synthetic oligonucleotide

SEQ ID NO: 422121 - DNA, 31 bp, Artificial Sequence; identical to SEQ ID NO: 73899
  Description of Artificial Sequence: Synthetic oligonucleotide

SEQ ID NO: 422122 - DNA, 30 bp, Artificial Sequence; identical to SEQ ID NO: 73900
  Description of Artificial Sequence: Synthetic oligonucleotide

SEQ ID NO: 422123 - DNA, 29 bp, Artificial Sequence
  Description of Artificial Sequence: Synthetic oligonucleotide
tcataaccaggaggagttcctgcgcttcg

SEQ ID NO: 422124 - DNA, 28 bp, Artificial Sequence
  Description of Artificial Sequence: Synthetic oligonucleotide
acacccgaccacgtttcttggagctgtg

SEQ ID NO: 422125 - DNA, 27 bp, Artificial Sequence
  Description of Artificial Sequence: Synthetic oligonucleotide
cacccgaccacgtttcttggagctgtg

SEQ ID NO: 422126 - DNA, 30 bp, Artificial Sequence; identical to SEQ ID NO: 73904
  Description of Artificial Sequence: Synthetic oligonucleotide

SEQ ID NO: 422127 - DNA, 29 bp, Artificial Sequence
  Description of Artificial Sequence: Synthetic oligonucleotide
cccgaccacgtttcttggagctgtgtaag

SEQ ID NO: 422128 - DNA, 30 bp, Artificial Sequence; identical to SEQ ID NO: 73906
  Description of Artificial Sequence: Synthetic oligonucleotide

SEQ ID NO: 422129 - DNA, 31 bp, Artificial Sequence; identical to SEQ ID NO: 73907
  Description of Artificial Sequence: Synthetic oligonucleotide

SEQ ID NO: 422130 - DNA, 32 bp, Artificial Sequence; identical to SEQ ID NO: 73908
  Description of Artificial Sequence: Synthetic oligonucleotide

SEQ ID NO: 422131 - DNA, 33 bp, Artificial Sequence; identical to SEQ ID NO: 73909
  Description of Artificial Sequence: Synthetic oligonucleotide

SEQ ID NO: 422132 - DNA, 32 bp, Artificial Sequence; identical to SEQ ID NO: 73910
  Description of Artificial Sequence: Synthetic oligonucleotide

SEQ ID NO: 422133 - DNA, 33 bp, Artificial Sequence; identical to SEQ ID NO: 73911
  Description of Artificial Sequence: Synthetic oligonucleotide

SEQ ID NO: 422134 - DNA, 37 bp, Artificial Sequence; identical to SEQ ID NO: 73912
  Description of Artificial Sequence: Synthetic oligonucleotide

SEQ ID NO: 422135 - DNA, 36 bp, Artificial Sequence; identical to SEQ ID NO: 73913
  Description of Artificial Sequence: Synthetic oligonucleotide

SEQ ID NO: 422136 - DNA, 38 bp, Artificial Sequence; identical to SEQ ID NO: 73914
  Description of Artificial Sequence: Synthetic oligonucleotide

SEQ ID NO: 422137 - DNA, 41 bp, Artificial Sequence; identical to SEQ ID NO: 73915
  Description of Artificial Sequence: Synthetic oligonucleotide

SEQ ID NO: 422138 - DNA, 40 bp, Artificial Sequence; identical to SEQ ID NO: 73916
  Description of Artificial Sequence: Synthetic oligonucleotide

SEQ ID NO: 422139 - DNA, 39 bp, Artificial Sequence; identical to SEQ ID NO: 73917
  Description of Artificial Sequence: Synthetic oligonucleotide

SEQ ID NO: 422140 - DNA, 38 bp, Artificial Sequence; identical to SEQ ID NO: 73918
  Description of Artificial Sequence: Synthetic oligonucleotide

SEQ ID NO: 422141 - DNA, 38 bp, Artificial Sequence; identical to SEQ ID NO: 73919
  Description of Artificial Sequence: Synthetic oligonucleotide

SEQ ID NO: 422142 - DNA, 37 bp, Artificial Sequence; identical to SEQ ID NO: 73920
  Description of Artificial Sequence: Synthetic oligonucleotide

SEQ ID NO: 422143 - DNA, 36 bp, Artificial Sequence; identical to SEQ ID NO: 73921
  Description of Artificial Sequence: Synthetic oligonucleotide

SEQ ID NO: 422144 - DNA, 36 bp, Artificial Sequence; identical to SEQ ID NO: 73922
  Description of Artificial Sequence: Synthetic oligonucleotide

SEQ ID NO: 422145 - DNA, 37 bp, Artificial Sequence; identical to SEQ ID NO: 73923
  Description of Artificial Sequence: Synthetic oligonucleotide

SEQ ID NO: 422146 - DNA, 36 bp, Artificial Sequence; identical to SEQ ID NO: 73924
  Description of Artificial Sequence: Synthetic oligonucleotide

SEQ ID NO: 422147 - DNA, 36 bp, Artificial Sequence; identical to SEQ ID NO: 73925
  Description of Artificial Sequence: Synthetic oligonucleotide

SEQ ID NO: 422148 - DNA, 36 bp, Artificial Sequence; identical to SEQ ID NO: 73926
  Description of Artificial Sequence: Synthetic oligonucleotide

SEQ ID NO: 422149 - DNA, 35 bp, Artificial Sequence; identical to SEQ ID NO: 73927
  Description of Artificial Sequence: Synthetic oligonucleotide

SEQ ID NO: 422150 - DNA, 36 bp, Artificial Sequence; identical to SEQ ID NO: 73928
  Description of Artificial Sequence: Synthetic oligonucleotide

SEQ ID NO: 422151 - DNA, 23 bp, Artificial Sequence
  Description of Artificial Sequence: Synthetic oligonucleotide
ggagcgggtgcggtacctggaga

SEQ ID NO: 422152 - DNA, 26 bp, Artificial Sequence
  Description of Artificial Sequence: Synthetic oligonucleotide
gagcgggtgcggtacctggagagata

SEQ ID NO: 422153 - DNA, 27 bp, Artificial Sequence
  Description of Artificial Sequence: Synthetic oligonucleotide
agcgggtgcggtacctggagagatact

SEQ ID NO: 422154 - DNA, 27 bp, Artificial Sequence
  Description of Artificial Sequence: Synthetic oligonucleotide
gcgggtgcggtacctggagagatactt

SEQ ID NO: 422155 - DNA, 27 bp, Artificial Sequence
  Description of Artificial Sequence: Synthetic oligonucleotide
cgggtgcggtacctggagagatacttc

SEQ ID NO: 422156 - DNA, 27 bp, Artificial Sequence
  Description of Artificial Sequence: Synthetic oligonucleotide
gggtgcggtacctggagagatacttcc

SEQ ID NO: 422157 - DNA, 31 bp, Artificial Sequence; identical to SEQ ID NO: 73935
  Description of Artificial Sequence: Synthetic oligonucleotide

SEQ ID NO: 422158 - DNA, 31 bp, Artificial Sequence; identical to SEQ ID NO: 73936
  Description of Artificial Sequence: Synthetic oligonucleotide

SEQ ID NO: 422159 - DNA, 32 bp, Artificial Sequence; identical to SEQ ID NO: 73937
  Description of Artificial Sequence: Synthetic oligonucleotide

SEQ ID NO: 422160 - DNA, 31 bp, Artificial Sequence; identical to SEQ ID NO: 73938
  Description of Artificial Sequence: Synthetic oligonucleotide

SEQ ID NO: 422161 - DNA, 31 bp, Artificial Sequence; identical to SEQ ID NO: 73939
  Description of Artificial Sequence: Synthetic oligonucleotide

SEQ ID NO: 422162 - DNA, 32 bp, Artificial Sequence; identical to SEQ ID NO: 73940
  Description of Artificial Sequence: Synthetic oligonucleotide

SEQ ID NO: 422163 - DNA, 32 bp, Artificial Sequence; identical to SEQ ID NO: 73941
  Description of Artificial Sequence: Synthetic oligonucleotide

SEQ ID NO: 422164 - DNA, 33 bp, Artificial Sequence; identical to SEQ ID NO: 73942
  Description of Artificial Sequence: Synthetic oligonucleotide

SEQ ID NO: 422165 - DNA, 32 bp, Artificial Sequence; identical to SEQ ID NO: 73943
  Description of Artificial Sequence: Synthetic oligonucleotide

SEQ ID NO: 422166 - DNA, 29 bp, Artificial Sequence
  Description of Artificial Sequence: Synthetic oligonucleotide
cacgtttctcggagctgcgtaagtctgag

SEQ ID NO: 422167 - DNA, 30 bp, Artificial Sequence; identical to SEQ ID NO: 73945
  Description of Artificial Sequence: Synthetic oligonucleotide

SEQ ID NO: 422168 - DNA, 29 bp, Artificial Sequence
  Description of Artificial Sequence: Synthetic oligonucleotide
cgtttctcggagctgcgtaagtctgagtg

SEQ ID NO: 422169 - DNA, 30 bp, Artificial Sequence; identical to SEQ ID NO: 73947
  Description of Artificial Sequence: Synthetic oligonucleotide

SEQ ID NO: 422170 - DNA, 34 bp, Artificial Sequence; identical to SEQ ID NO: 73948
  Description of Artificial Sequence: Synthetic oligonucleotide

SEQ ID NO: 422171 - DNA, 33 bp, Artificial Sequence; identical to SEQ ID NO: 73949
  Description of Artificial Sequence: Synthetic oligonucleotide

SEQ ID NO: 422172 - DNA, 32 bp, Artificial Sequence; identical to SEQ ID NO: 73950
  Description of Artificial Sequence: Synthetic oligonucleotide

SEQ ID NO: 422173 - DNA, 31 bp, Artificial Sequence; identical to SEQ ID NO: 73951
  Description of Artificial Sequence: Synthetic oligonucleotide

SEQ ID NO: 422174 - DNA, 33 bp, Artificial Sequence; identical to SEQ ID NO: 73952
  Description of Artificial Sequence: Synthetic oligonucleotide

SEQ ID NO: 422175 - DNA, 32 bp, Artificial Sequence; identical to SEQ ID NO: 73953
  Description of Artificial Sequence: Synthetic oligonucleotide

SEQ ID NO: 422176 - DNA, 24 bp, Artificial Sequence
  Description of Artificial Sequence: Synthetic oligonucleotide
gacggagcgggtgcggtacctgaa

SEQ ID NO: 422177 - DNA, 25 bp, Artificial Sequence
  Description of Artificial Sequence: Synthetic oligonucleotide
acggagcgggtgcggtacctgaaca

SEQ ID NO: 422178 - DNA, 24 bp, Artificial Sequence
  Description of Artificial Sequence: Synthetic oligonucleotide
cggagcgggtgcggtacctgaaca

SEQ ID NO: 422179 - DNA, 27 bp, Artificial Sequence
  Description of Artificial Sequence: Synthetic oligonucleotide
ggagcgggtgcggtacctgaacagata

SEQ ID NO: 422180 - DNA, 27 bp, Artificial Sequence
  Description of Artificial Sequence: Synthetic oligonucleotide
gagcgggtgcggtacctgaacagatac

SEQ ID NO: 422181 - DNA, 29 bp, Artificial Sequence
  Description of Artificial Sequence: Synthetic oligonucleotide
agcgggtgcggtacctgaacagatacttc

SEQ ID NO: 422182 - DNA, 28 bp, Artificial Sequence
  Description of Artificial Sequence: Synthetic oligonucleotide
gcgggtgcggtacctgaacagatacttc

SEQ ID NO: 422183 - DNA, 28 bp, Artificial Sequence
  Description of Artificial Sequence: Synthetic oligonucleotide
cgggtgcggtacctgaacagatacttcc

SEQ ID NO: 422184 - DNA, 32 bp, Artificial Sequence; identical to SEQ ID NO: 73962
  Description of Artificial Sequence: Synthetic oligonucleotide

SEQ ID NO: 422185 - DNA, 32 bp, Artificial Sequence; identical to SEQ ID NO: 73963
  Description of Artificial Sequence: Synthetic oligonucleotide

SEQ ID NO: 422186 - DNA, 33 bp, Artificial Sequence; identical to SEQ ID NO: 73964
  Description of Artificial Sequence: Synthetic oligonucleotide

SEQ ID NO: 422187 - DNA, 33 bp, Artificial Sequence; identical to SEQ ID NO: 73965
  Description of Artificial Sequence: Synthetic oligonucleotide

SEQ ID NO: 422188 - DNA, 32 bp, Artificial Sequence; identical to SEQ ID NO: 73966
  Description of Artificial Sequence: Synthetic oligonucleotide

SEQ ID NO: 422189 - DNA, 33 bp, Artificial Sequence; identical to SEQ ID NO: 73967
  Description of Artificial Sequence: Synthetic oligonucleotide

SEQ ID NO: 422190 - DNA, 33 bp, Artificial Sequence; identical to SEQ ID NO: 73968
  Description of Artificial Sequence: Synthetic oligonucleotide

SEQ ID NO: 422191 - DNA, 34 bp, Artificial Sequence; identical to SEQ ID NO: 73969
  Description of Artificial Sequence: Synthetic oligonucleotide

SEQ ID NO: 422192 - DNA, 36 bp, Artificial Sequence; identical to SEQ ID NO: 73970
  Description of Artificial Sequence: Synthetic oligonucleotide

SEQ ID NO: 422193 - DNA, 35 bp, Artificial Sequence; identical to SEQ ID NO: 73971
  Description of Artificial Sequence: Synthetic oligonucleotide

SEQ ID NO: 422194 - DNA, 34 bp, Artificial Sequence; identical to SEQ ID NO: 73972
  Description of Artificial Sequence: Synthetic oligonucleotide

SEQ ID NO: 422195 - DNA, 34 bp, Artificial Sequence; identical to SEQ ID NO: 73973
  Description of Artificial Sequence: Synthetic oligonucleotide

SEQ ID NO: 422196 - DNA, 35 bp, Artificial Sequence; identical to SEQ ID NO: 73974
  Description of Artificial Sequence: Synthetic oligonucleotide

SEQ ID NO: 422197 - DNA, 34 bp, Artificial Sequence; identical to SEQ ID NO: 73975
  Description of Artificial Sequence: Synthetic oligonucleotide

SEQ ID NO: 422198 - DNA, 34 bp, Artificial Sequence; identical to SEQ ID NO: 73976
  Description of Artificial Sequence: Synthetic oligonucleotide

SEQ ID NO: 422199 - DNA, 32 bp, Artificial Sequence; identical to SEQ ID NO: 73977
  Description of Artificial Sequence: Synthetic oligonucleotide

SEQ ID NO: 422200 - DNA, 31 bp, Artificial Sequence; identical to SEQ ID NO: 73978
  Description of Artificial Sequence: Synthetic oligonucleotide

SEQ ID NO: 422201 - DNA, 31 bp, Artificial Sequence; identical to SEQ ID NO: 73979
  Description of Artificial Sequence: Synthetic oligonucleotide

SEQ ID NO: 422202 - DNA, 31 bp, Artificial Sequence; identical to SEQ ID NO: 73980
  Description of Artificial Sequence: Synthetic oligonucleotide

SEQ ID NO: 422203 - DNA, 30 bp, Artificial Sequence; identical to SEQ ID NO: 73981
  Description of Artificial Sequence: Synthetic oligonucleotide

SEQ ID NO: 422204 - DNA, 30 bp, Artificial Sequence; identical to SEQ ID NO: 73982
  Description of Artificial Sequence: Synthetic oligonucleotide

SEQ ID NO: 422205 - DNA, 29 bp, Artificial Sequence
  Description of Artificial Sequence: Synthetic oligonucleotide
gacacttccataaccaggaggagtacgcg

SEQ ID NO: 422206 - DNA, 29 bp, Artificial Sequence
  Description of Artificial Sequence: Synthetic oligonucleotide
acacttccataaccaggaggagtacgcgc

SEQ ID NO: 422207 - DNA, 28 bp, Artificial Sequence
  Description of Artificial Sequence: Synthetic oligonucleotide
cacttccataaccaggaggagtacgcgc

SEQ ID NO: 422208 - DNA, 34 bp, Artificial Sequence; identical to SEQ ID NO: 73986
  Description of Artificial Sequence: Synthetic oligonucleotide

SEQ ID NO: 422209 - DNA, 33 bp, Artificial Sequence; identical to SEQ ID NO: 73987
  Description of Artificial Sequence: Synthetic oligonucleotide

SEQ ID NO: 422210 - DNA, 33 bp, Artificial Sequence; identical to SEQ ID NO: 73988
  Description of Artificial Sequence: Synthetic oligonucleotide

SEQ ID NO: 422211 - DNA, 32 bp, Artificial Sequence; identical to SEQ ID NO: 73989
  Description of Artificial Sequence: Synthetic oligonucleotide

SEQ ID NO: 422212 - DNA, 34 bp, Artificial Sequence; identical to SEQ ID NO: 73990
  Description of Artificial Sequence: Synthetic oligonucleotide

SEQ ID NO: 422213 - DNA, 33 bp, Artificial Sequence; identical to SEQ ID NO: 73991
  Description of Artificial Sequence: Synthetic oligonucleotide

SEQ ID NO: 422214 - DNA, 32 bp, Artificial Sequence; identical to SEQ ID NO: 73992
  Description of Artificial Sequence: Synthetic oligonucleotide

SEQ ID NO: 422215 - DNA, 31 bp, Artificial Sequence; identical to SEQ ID NO: 73993
  Description of Artificial Sequence: Synthetic oligonucleotide

SEQ ID NO: 422216 - DNA, 31 bp, Artificial Sequence; identical to SEQ ID NO: 73994
  Description of Artificial Sequence: Synthetic oligonucleotide

SEQ ID NO: 422217 - DNA, 30 bp, Artificial Sequence; identical to SEQ ID NO: 73995
  Description of Artificial Sequence: Synthetic oligonucleotide

SEQ ID NO: 422218 - DNA, 29 bp, Artificial Sequence
  Description of Artificial Sequence: Synthetic oligonucleotide
ccataaccaggaggagttcctgagcttcg

SEQ ID NO: 422219 - DNA, 30 bp, Artificial Sequence; identical to SEQ ID NO: 73997
  Description of Artificial Sequence: Synthetic oligonucleotide

SEQ ID NO: 422220 - DNA, 31 bp, Artificial Sequence; identical to SEQ ID NO: 73998
  Description of Artificial Sequence: Synthetic oligonucleotide

SEQ ID NO: 422221 - DNA, 30 bp, Artificial Sequence; identical to SEQ ID NO: 73999
  Description of Artificial Sequence: Synthetic oligonucleotide

SEQ ID NO: 422222 - DNA, 29 bp, Artificial Sequence
  Description of Artificial Sequence: Synthetic oligonucleotide
aaccaggaggagttcctgagcttcgacag

SEQ ID NO: 422223 - DNA, 28 bp, Artificial Sequence
  Description of Artificial Sequence: Synthetic oligonucleotide
accaggaggagttcctgagcttcgacag

SEQ ID NO: 422224 - DNA, 27 bp, Artificial Sequence
  Description of Artificial Sequence: Synthetic oligonucleotide
ccaggaggagttcctgagcttcgacag

SEQ ID NO: 422225 - DNA, 27 bp, Artificial Sequence
  Description of Artificial Sequence: Synthetic oligonucleotide
caggaggagttcctgagcttcgacagc

SEQ ID NO: 422226 - DNA, 27 bp, Artificial Sequence
  Description of Artificial Sequence: Synthetic oligonucleotide
aggaggagttcctgagcttcgacagcg

SEQ ID NO: 422227 - DNA, 27 bp, Artificial Sequence
  Description of Artificial Sequence: Synthetic oligonucleotide
ggaggagttcctgagcttcgacagcga

SEQ ID NO: 422228 - DNA, 27 bp, Artificial Sequence
  Description of Artificial Sequence: Synthetic oligonucleotide
gaggagttcctgagcttcgacagcgac

SEQ ID NO: 422229 - DNA, 27 bp, Artificial Sequence
  Description of Artificial Sequence: Synthetic oligonucleotide
aggagttcctgagcttcgacagcgacg

SEQ ID NO: 422230 - DNA, 27 bp, Artificial Sequence
  Description of Artificial Sequence: Synthetic oligonucleotide
ggagttcctgagcttcgacagcgacgt

SEQ ID NO: 422231 - DNA, 27 bp, Artificial Sequence
  Description of Artificial Sequence: Synthetic oligonucleotide
gagttcctgagcttcgacagcgacgtg

SEQ ID NO: 422232 - DNA, 27 bp, Artificial Sequence
  Description of Artificial Sequence: Synthetic oligonucleotide
agttcctgagcttcgacagcgacgtgg

SEQ ID NO: 422233 - DNA, 26 bp, Artificial Sequence
  Description of Artificial Sequence: Synthetic oligonucleotide
gttcctgagcttcgacagcgacgtgg

SEQ ID NO: 422234 - DNA, 26 bp, Artificial Sequence
  Description of Artificial Sequence: Synthetic oligonucleotide
ttcctgagcttcgacagcgacgtggg

SEQ ID NO: 422235 - DNA, 25 bp, Artificial Sequence
  Description of Artificial Sequence: Synthetic oligonucleotide
tcctgagcttcgacagcgacgtggg

SEQ ID NO: 422236 - DNA, 24 bp, Artificial Sequence
  Description of Artificial Sequence: Synthetic oligonucleotide
cctgagcttcgacagcgacgtggg

SEQ ID NO: 422237 - DNA, 24 bp, Artificial Sequence
  Description of Artificial Sequence: Synthetic oligonucleotide
ctgagcttcgacagcgacgtgggg

SEQ ID NO: 422238 - DNA, 25 bp, Artificial Sequence
  Description of Artificial Sequence: Synthetic oligonucleotide
tgagcttcgacagcgacgtggggga

SEQ ID NO: 422239 - DNA, 24 bp, Artificial Sequence
  Description of Artificial Sequence: Synthetic oligonucleotide
gagcttcgacagcgacgtggggga

SEQ ID NO: 422240 - DNA, 26 bp, Artificial Sequence
  Description of Artificial Sequence: Synthetic oligonucleotide
agcttcgacagcgacgtgggggagta

SEQ ID NO: 422241 - DNA, 27 bp, Artificial Sequence
  Description of Artificial Sequence: Synthetic oligonucleotide
ggagcgggtgcggtacctggacatata

SEQ ID NO: 422242 - DNA, 27 bp, Artificial Sequence
  Description of Artificial Sequence: Synthetic oligonucleotide
gagcgggtgcggtacctggacatatac

SEQ ID NO: 422243 - DNA, 29 bp, Artificial Sequence
  Description of Artificial Sequence: Synthetic oligonucleotide
agcgggtgcggtacctggacatatacttc

SEQ ID NO: 422244 - DNA, 28 bp, Artificial Sequence
  Description of Artificial Sequence: Synthetic oligonucleotide
gcgggtgcggtacctggacatatacttc

SEQ ID NO: 422245 - DNA, 28 bp, Artificial Sequence
  Description of Artificial Sequence: Synthetic oligonucleotide
cgggtgcggtacctggacatatacttcc

SEQ ID NO: 422246 - DNA, 32 bp, Artificial Sequence; identical to SEQ ID NO: 74024
  Description of Artificial Sequence: Synthetic oligonucleotide

SEQ ID NO: 422247 - DNA, 32 bp, Artificial Sequence; identical to SEQ ID NO: 74025
  Description of Artificial Sequence: Synthetic oligonucleotide

SEQ ID NO: 422248 - DNA, 33 bp, Artificial Sequence; identical to SEQ ID NO: 74026
  Description of Artificial Sequence: Synthetic oligonucleotide

SEQ ID NO: 422249 - DNA, 33 bp, Artificial Sequence; identical to SEQ ID NO: 74027
  Description of Artificial Sequence: Synthetic oligonucleotide

SEQ ID NO: 422250 - DNA, 32 bp, Artificial Sequence; identical to SEQ ID NO: 74028
  Description of Artificial Sequence: Synthetic oligonucleotide

SEQ ID NO: 422251 - DNA, 33 bp, Artificial Sequence; identical to SEQ ID NO: 74029
  Description of Artificial Sequence: Synthetic oligonucleotide

SEQ ID NO: 422252 - DNA, 33 bp, Artificial Sequence; identical to SEQ ID NO: 74030
  Description of Artificial Sequence: Synthetic oligonucleotide

SEQ ID NO: 422253 - DNA, 34 bp, Artificial Sequence; identical to SEQ ID NO: 74031
  Description of Artificial Sequence: Synthetic oligonucleotide

SEQ ID NO: 422254 - DNA, 36 bp, Artificial Sequence; identical to SEQ ID NO: 74032
  Description of Artificial Sequence: Synthetic oligonucleotide

SEQ ID NO: 422255 - DNA, 35 bp, Artificial Sequence; identical to SEQ ID NO: 74033
  Description of Artificial Sequence: Synthetic oligonucleotide

SEQ ID NO: 422256 - DNA, 34 bp, Artificial Sequence; identical to SEQ ID NO: 74034
  Description of Artificial Sequence: Synthetic oligonucleotide

SEQ ID NO: 422257 - DNA, 34 bp, Artificial Sequence; identical to SEQ ID NO: 74035
  Description of Artificial Sequence: Synthetic oligonucleotide

SEQ ID NO: 422258 - DNA, 35 bp, Artificial Sequence; identical to SEQ ID NO: 74036
  Description of Artificial Sequence: Synthetic oligonucleotide

SEQ ID NO: 422259 - DNA, 34 bp, Artificial Sequence; identical to SEQ ID NO: 74037
  Description of Artificial Sequence: Synthetic oligonucleotide

SEQ ID NO: 422260 - DNA, 34 bp, Artificial Sequence; identical to SEQ ID NO: 74038
  Description of Artificial Sequence: Synthetic oligonucleotide

SEQ ID NO: 422261 - DNA, 34 bp, Artificial Sequence; identical to SEQ ID NO: 74039
  Description of Artificial Sequence: Synthetic oligonucleotide

SEQ ID NO: 422262 - DNA, 33 bp, Artificial Sequence; identical to SEQ ID NO: 74040
  Description of Artificial Sequence: Synthetic oligonucleotide

SEQ ID NO: 422263 - DNA, 33 bp, Artificial Sequence; identical to SEQ ID NO: 74041
  Description of Artificial Sequence: Synthetic oligonucleotide

SEQ ID NO: 422264 - DNA, 32 bp, Artificial Sequence; identical to SEQ ID NO: 74042
  Description of Artificial Sequence: Synthetic oligonucleotide

SEQ ID NO: 422265 - DNA, 31 bp, Artificial Sequence; identical to SEQ ID NO: 74043
  Description of Artificial Sequence: Synthetic oligonucleotide

SEQ ID NO: 422266 - DNA, 31 bp, Artificial Sequence; identical to SEQ ID NO: 74044
  Description of Artificial Sequence: Synthetic oligonucleotide

SEQ ID NO: 422267 - DNA, 31 bp, Artificial Sequence; identical to SEQ ID NO: 74045
  Description of Artificial Sequence: Synthetic oligonucleotide

SEQ ID NO: 422268 - DNA, 31 bp, Artificial Sequence; identical to SEQ ID NO: 74046
  Description of Artificial Sequence: Synthetic oligonucleotide

SEQ ID NO: 422269 - DNA, 33 bp, Artificial Sequence; identical to SEQ ID NO: 74047
  Description of Artificial Sequence: Synthetic oligonucleotide

SEQ ID NO: 422270 - DNA, 32 bp, Artificial Sequence; identical to SEQ ID NO: 74048
  Description of Artificial Sequence: Synthetic oligonucleotide

SEQ ID NO: 422271 - DNA, 32 bp, Artificial Sequence; identical to SEQ ID NO: 74049
  Description of Artificial Sequence: Synthetic oligonucleotide

SEQ ID NO: 422272 - DNA, 33 bp, Artificial Sequence; identical to SEQ ID NO: 74050
  Description of Artificial Sequence: Synthetic oligonucleotide

SEQ ID NO: 422273 - DNA, 32 bp, Artificial Sequence; identical to SEQ ID NO: 74051
  Description of Artificial Sequence: Synthetic oligonucleotide

SEQ ID NO: 422274 - DNA, 33 bp, Artificial Sequence; identical to SEQ ID NO: 74052
  Description of Artificial Sequence: Synthetic oligonucleotide

SEQ ID NO: 422275 - DNA, 32 bp, Artificial Sequence; identical to SEQ ID NO: 74053
  Description of Artificial Sequence: Synthetic oligonucleotide

SEQ ID NO: 422276 - DNA, 31 bp, Artificial Sequence; identical to SEQ ID NO: 74054
  Description of Artificial Sequence: Synthetic oligonucleotide

SEQ ID NO: 422277 - DNA, 27 bp, Artificial Sequence
  Description of Artificial Sequence: Synthetic oligonucleotide
cacccgaccacgtttcttggagctgct

SEQ ID NO: 422278 - DNA, 30 bp, Artificial Sequence; identical to SEQ ID NO: 74085
  Description of Artificial Sequence: Synthetic oligonucleotide

SEQ ID NO: 422279 - DNA, 29 bp, Artificial Sequence
  Description of Artificial Sequence: Synthetic oligonucleotide
cccgaccacgtttcttggagctgcttaag

SEQ ID NO: 422280 - DNA, 30 bp, Artificial Sequence; identical to SEQ ID NO: 74087
  Description of Artificial Sequence: Synthetic oligonucleotide

SEQ ID NO: 422281 - DNA, 31 bp, Artificial Sequence; identical to SEQ ID NO: 74088
  Description of Artificial Sequence: Synthetic oligonucleotide

SEQ ID NO: 422282 - DNA, 32 bp, Artificial Sequence; identical to SEQ ID NO: 74089
  Description of Artificial Sequence: Synthetic oligonucleotide

SEQ ID NO: 422283 - DNA, 33 bp, Artificial Sequence; identical to SEQ ID NO: 74090
  Description of Artificial Sequence: Synthetic oligonucleotide

SEQ ID NO: 422284 - DNA, 32 bp, Artificial Sequence; identical to SEQ ID NO: 74091
  Description of Artificial Sequence: Synthetic oligonucleotide

SEQ ID NO: 422285 - DNA, 34 bp, Artificial Sequence; identical to SEQ ID NO: 74092
  Description of Artificial Sequence: Synthetic oligonucleotide

SEQ ID NO: 422286 - DNA, 33 bp, Artificial Sequence; identical to SEQ ID NO: 74093
  Description of Artificial Sequence: Synthetic oligonucleotide

SEQ ID NO: 422287 - DNA, 33 bp, Artificial Sequence; identical to SEQ ID NO: 74094
  Description of Artificial Sequence: Synthetic oligonucleotide

SEQ ID NO: 422288 - DNA, 34 bp, Artificial Sequence; identical to SEQ ID NO: 74095
  Description of Artificial Sequence: Synthetic oligonucleotide

SEQ ID NO: 422289 - DNA, 33 bp, Artificial Sequence; identical to SEQ ID NO: 74096
  Description of Artificial Sequence: Synthetic oligonucleotide

SEQ ID NO: 422290 - DNA, 32 bp, Artificial Sequence; identical to SEQ ID NO: 74097
  Description of Artificial Sequence: Synthetic oligonucleotide

SEQ ID NO: 422291 - DNA, 32 bp, Artificial Sequence; identical to SEQ ID NO: 74098
  Description of Artificial Sequence: Synthetic oligonucleotide

SEQ ID NO: 422292 - DNA, 32 bp, Artificial Sequence; identical to SEQ ID NO: 74099
  Description of Artificial Sequence: Synthetic oligonucleotide

SEQ ID NO: 422293 - DNA, 31 bp, Artificial Sequence; identical to SEQ ID NO: 74100
  Description of Artificial Sequence: Synthetic oligonucleotide

SEQ ID NO: 422294 - DNA, 32 bp, Artificial Sequence; identical to SEQ ID NO: 74101
  Description of Artificial Sequence: Synthetic oligonucleotide

SEQ ID NO: 422295 - DNA, 31 bp, Artificial Sequence; identical to SEQ ID NO: 74102
  Description of Artificial Sequence: Synthetic oligonucleotide

SEQ ID NO: 422296 - DNA, 32 bp, Artificial Sequence; identical to SEQ ID NO: 74103
  Description of Artificial Sequence: Synthetic oligonucleotide

SEQ ID NO: 422297 - DNA, 32 bp, Artificial Sequence; identical to SEQ ID NO: 74104
  Description of Artificial Sequence: Synthetic oligonucleotide

SEQ ID NO: 422298 - DNA, 33 bp, Artificial Sequence; identical to SEQ ID NO: 74105
  Description of Artificial Sequence: Synthetic oligonucleotide

SEQ ID NO: 422299 - DNA, 32 bp, Artificial Sequence; identical to SEQ ID NO: 74106
  Description of Artificial Sequence: Synthetic oligonucleotide

SEQ ID NO: 422300 - DNA, 33 bp, Artificial Sequence; identical to SEQ ID NO: 74107
  Description of Artificial Sequence: Synthetic oligonucleotide

SEQ ID NO: 422301 - DNA, 33 bp, Artificial Sequence; identical to SEQ ID NO: 74108
  Description of Artificial Sequence: Synthetic oligonucleotide

SEQ ID NO: 422302 - DNA, 32 bp, Artificial Sequence; identical to SEQ ID NO: 74109
  Description of Artificial Sequence: Synthetic oligonucleotide

SEQ ID NO: 422303 - DNA, 36 bp, Artificial Sequence; identical to SEQ ID NO: 74110
  Description of Artificial Sequence: Synthetic oligonucleotide

SEQ ID NO: 422304 - DNA, 35 bp, Artificial Sequence; identical to SEQ ID NO: 74111
  Description of Artificial Sequence: Synthetic oligonucleotide

SEQ ID NO: 422305 - DNA, 34 bp, Artificial Sequence; identical to SEQ ID NO: 74112
  Description of Artificial Sequence: Synthetic oligonucleotide

SEQ ID NO: 422306 - DNA, 35 bp, Artificial Sequence; identical to SEQ ID NO: 74113
  Description of Artificial Sequence: Synthetic oligonucleotide

SEQ ID NO: 422307 - DNA, 35 bp, Artificial Sequence; identical to SEQ ID NO: 74114
  Description of Artificial Sequence: Synthetic oligonucleotide

SEQ ID NO: 422308 - DNA, 34 bp, Artificial Sequence; identical to SEQ ID NO: 74115
  Description of Artificial Sequence: Synthetic oligonucleotide

SEQ ID NO: 422309 - DNA, 33 bp, Artificial Sequence; identical to SEQ ID NO: 74116
  Description of Artificial Sequence: Synthetic oligonucleotide

SEQ ID NO: 422310 - DNA, 34 bp, Artificial Sequence; identical to SEQ ID NO: 74117
  Description of Artificial Sequence: Synthetic oligonucleotide

SEQ ID NO: 422311 - DNA, 33 bp, Artificial Sequence; identical to SEQ ID NO: 74118
  Description of Artificial Sequence: Synthetic oligonucleotide

SEQ ID NO: 422312 - DNA, 32 bp, Artificial Sequence; identical to SEQ ID NO: 74119
  Description of Artificial Sequence: Synthetic oligonucleotide

SEQ ID NO: 422313 - DNA, 31 bp, Artificial Sequence; identical to SEQ ID NO: 74120
  Description of Artificial Sequence: Synthetic oligonucleotide

SEQ ID NO: 422314 - DNA, 31 bp, Artificial Sequence; identical to SEQ ID NO: 74121
  Description of Artificial Sequence: Synthetic oligonucleotide

SEQ ID NO: 422315 - DNA, 30 bp, Artificial Sequence; identical to SEQ ID NO: 74122
  Description of Artificial Sequence: Synthetic oligonucleotide

SEQ ID NO: 422316 - DNA, 27 bp, Artificial Sequence
  Description of Artificial Sequence: Synthetic oligonucleotide
acctgccaagtggagcacccaagcgta

SEQ ID NO: 422317 - DNA, 27 bp, Artificial Sequence
  Description of Artificial Sequence: Synthetic oligonucleotide
cctgccaagtggagcacccaagcgtaa

SEQ ID NO: 422318 - DNA, 27 bp, Artificial Sequence
  Description of Artificial Sequence: Synthetic oligonucleotide
ctgccaagtggagcacccaagcgtaac

SEQ ID NO: 422319 - DNA, 27 bp, Artificial Sequence
  Description of Artificial Sequence: Synthetic oligonucleotide
aagtggagcacccaagcgtaacgagcc

SEQ ID NO: 422320 - DNA, 26 bp, Artificial Sequence
  Description of Artificial Sequence: Synthetic oligonucleotide
agtggagcacccaagcgtaacgagcc

SEQ ID NO: 422321 - DNA, 25 bp, Artificial Sequence
  Description of Artificial Sequence: Synthetic oligonucleotide
gtggagcacccaagcgtaacgagcc

SEQ ID NO: 422322 - DNA, 26 bp, Artificial Sequence
  Description of Artificial Sequence: Synthetic oligonucleotide
tggagcacccaagcgtaacgagccct

SEQ ID NO: 422323 - DNA, 25 bp, Artificial Sequence
  Description of Artificial Sequence: Synthetic oligonucleotide
ggagcacccaagcgtaacgagccct

SEQ ID NO: 422324 - DNA, 26 bp, Artificial Sequence
  Description of Artificial Sequence: Synthetic oligonucleotide
gagcacccaagcgtaacgagccctct

SEQ ID NO: 422325 - DNA, 27 bp, Artificial Sequence
  Description of Artificial Sequence: Synthetic oligonucleotide
agcacccaagcgtaacgagccctctca

SEQ ID NO: 422326 - DNA, 26 bp, Artificial Sequence
  Description of Artificial Sequence: Synthetic oligonucleotide
gcacccaagcgtaacgagccctctca

SEQ ID NO: 422327 - DNA, 27 bp, Artificial Sequence
  Description of Artificial Sequence: Synthetic oligonucleotide
cacccaagcgtaacgagccctctcaca

SEQ ID NO: 422328 - DNA, 27 bp, Artificial Sequence
  Description of Artificial Sequence: Synthetic oligonucleotide
acccaagcgtaacgagccctctcacag

SEQ ID NO: 422329 - DNA, 27 bp, Artificial Sequence
  Description of Artificial Sequence: Synthetic oligonucleotide
cccaagcgtaacgagccctctcacagt

SEQ ID NO: 422330 - DNA, 27 bp, Artificial Sequence
  Description of Artificial Sequence: Synthetic oligonucleotide
ccaagcgtaacgagccctctcacagtg

SEQ ID NO: 422331 - DNA, 27 bp, Artificial Sequence
  Description of Artificial Sequence: Synthetic oligonucleotide
caagcgtaacgagccctctcacagtgg

SEQ ID NO: 422332 - DNA, 30 bp, Artificial Sequence; identical to SEQ ID NO: 74139
  Description of Artificial Sequence: Synthetic oligonucleotide

SEQ ID NO: 422333 - DNA, 29 bp, Artificial Sequence
  Description of Artificial Sequence: Synthetic oligonucleotide
agcgtaacgagccctctcacagtggaatg

SEQ ID NO: 422334 - DNA, 28 bp, Artificial Sequence
  Description of Artificial Sequence: Synthetic oligonucleotide
gcgtaacgagccctctcacagtggaatg

SEQ ID NO: 422335 - DNA, 28 bp, Artificial Sequence
  Description of Artificial Sequence: Synthetic oligonucleotide
cgtaacgagccctctcacagtggaatgg

SEQ ID NO: 422336 - DNA, 29 bp, Artificial Sequence
  Description of Artificial Sequence: Synthetic oligonucleotide
gtaacgagccctctcacagtggaatggag

SEQ ID NO: 422337 - DNA, 30 bp, Artificial Sequence; identical to SEQ ID NO: 74144
  Description of Artificial Sequence: Synthetic oligonucleotide

SEQ ID NO: 422338 - DNA, 29 bp, Artificial Sequence
  Description of Artificial Sequence: Synthetic oligonucleotide
aacgagccctctcacagtggaatggagtg

SEQ ID NO: 422339 - DNA, 28 bp, Artificial Sequence
  Description of Artificial Sequence: Synthetic oligonucleotide
acgagccctctcacagtggaatggagtg

SEQ ID NO: 422340 - DNA, 27 bp, Artificial Sequence
  Description of Artificial Sequence: Synthetic oligonucleotide
cgagccctctcacagtggaatggagtg

SEQ ID NO: 422341 - DNA, 27 bp, Artificial Sequence
  Description of Artificial Sequence: Synthetic oligonucleotide
gagccctctcacagtggaatggagtgc

SEQ ID NO: 422342 - DNA, 41 bp, Artificial Sequence
  Description of Artificial Sequence: Synthetic oligonucleotide
tcacaatagctccccaattaaagtgttttacatgcaactgg

SEQ ID NO: 422343 - DNA, 40 bp, Artificial Sequence
  Description of Artificial Sequence: Synthetic oligonucleotide
cacaatagctccccaattaaagtgttttacatgcaactgg

SEQ ID NO: 422344 - DNA, 42 bp, Artificial Sequence
  Description of Artificial Sequence: Synthetic oligonucleotide
acaatagctccccaattaaagtgttttacatgcaactggttc

SEQ ID NO: 422345 - DNA, 41 bp, Artificial Sequence
  Description of Artificial Sequence: Synthetic oligonucleotide
caatagctccccaattaaagtgttttacatgcaactggttc

SEQ ID NO: 422346 - DNA, 44 bp, Artificial Sequence
  Description of Artificial Sequence: Synthetic oligonucleotide
aatagctccccaattaaagtgttttacatgcaactggttcaaac

SEQ ID NO: 422347 - DNA, 43 bp, Artificial Sequence
  Description of Artificial Sequence: Synthetic oligonucleotide
atagctccccaattaaagtgttttacatgcaactggttcaaac

SEQ ID NO: 422348 - DNA, 42 bp, Artificial Sequence
  Description of Artificial Sequence: Synthetic oligonucleotide
tagctccccaattaaagtgttttacatgcaactggttcaaac

SEQ ID NO: 422349 - DNA, 41 bp, Artificial Sequence
  Description of Artificial Sequence: Synthetic oligonucleotide
agctccccaattaaagtgttttacatgcaactggttcaaac

SEQ ID NO: 422350 - DNA, 40 bp, Artificial Sequence
  Description of Artificial Sequence: Synthetic oligonucleotide
gctccccaattaaagtgttttacatgcaactggttcaaac

SEQ ID NO: 422351 - DNA, 40 bp, Artificial Sequence
  Description of Artificial Sequence: Synthetic oligonucleotide
ctccccaattaaagtgttttacatgcaactggttcaaacc

SEQ ID NO: 422352 - DNA, 43 bp, Artificial Sequence
  Description of Artificial Sequence: Synthetic oligonucleotide
tccccaattaaagtgttttacatgcaactggttcaaacctttc

SEQ ID NO: 422353 - DNA, 56 bp, Artificial Sequence
  Description of Artificial Sequence: Synthetic oligonucleotide
caattaaagtgttttacatgcaactggttcaaacctttcaagtactaaattaaaac

SEQ ID NO: 422354 - DNA, 59 bp, Artificial Sequence
  Description of Artificial Sequence: Synthetic oligonucleotide
aattaaagtgttttacatgcaactggttcaaacctttcaagtactaaattaaaacattc

SEQ ID NO: 422355 - DNA, 58 bp, Artificial Sequence
  Description of Artificial Sequence: Synthetic oligonucleotide
attaaagtgttttacatgcaactggttcaaacctttcaagtactaaattaaaacattc

SEQ ID NO: 422356 - DNA, 57 bp, Artificial Sequence
  Description of Artificial Sequence: Synthetic oligonucleotide
ttaaagtgttttacatgcaactggttcaaacctttcaagtactaaattaaaacattc

SEQ ID NO: 422357 - DNA, 56 bp, Artificial Sequence
  Description of Artificial Sequence: Synthetic oligonucleotide
taaagtgttttacatgcaactggttcaaacctttcaagtactaaattaaaacattc

SEQ ID NO: 422358 - DNA, 55 bp, Artificial Sequence
  Description of Artificial Sequence: Synthetic oligonucleotide
aaagtgttttacatgcaactggttcaaacctttcaagtactaaattaaaacattc

SEQ ID NO: 422359 - DNA, 54 bp, Artificial Sequence
  Description of Artificial Sequence: Synthetic oligonucleotide
aagtgttttacatgcaactggttcaaacctttcaagtactaaattaaaacattc

SEQ ID NO: 422360 - DNA, 53 bp, Artificial Sequence
  Description of Artificial Sequence: Synthetic oligonucleotide
agtgttttacatgcaactggttcaaacctttcaagtactaaattaaaacattc

SEQ ID NO: 422361 - DNA, 52 bp, Artificial Sequence
  Description of Artificial Sequence: Synthetic oligonucleotide
gtgttttacatgcaactggttcaaacctttcaagtactaaattaaaacattc

SEQ ID NO: 422362 - DNA, 52 bp, Artificial Sequence
  Description of Artificial Sequence: Synthetic oligonucleotide
tgttttacatgcaactggttcaaacctttcaagtactaaattaaaacattcc

SEQ ID NO: 422363 - DNA, 51 bp, Artificial Sequence
  Description of Artificial Sequence: Synthetic oligonucleotide
gttttacatgcaactggttcaaacctttcaagtactaaattaaaacattcc

SEQ ID NO: 422364 - DNA, 57 bp, Artificial Sequence
  Description of Artificial Sequence: Synthetic oligonucleotide
ttttacatgcaactggttcaaacctttcaagtactaaattaaaacattcctttaaag

SEQ ID NO: 422365 - DNA, 56 bp, Artificial Sequence
  Description of Artificial Sequence: Synthetic oligonucleotide
tttacatgcaactggttcaaacctttcaagtactaaattaaaacattcctttaaag

SEQ ID NO: 422366 - DNA, 55 bp, Artificial Sequence
  Description of Artificial Sequence: Synthetic oligonucleotide
ttacatgcaactggttcaaacctttcaagtactaaattaaaacattcctttaaag

SEQ ID NO: 422367 - DNA, 54 bp, Artificial Sequence
  Description of Artificial Sequence: Synthetic oligonucleotide
tacatgcaactggttcaaacctttcaagtactaaattaaaacattcctttaaag

SEQ ID NO: 422368 - DNA, 53 bp, Artificial Sequence
  Description of Artificial Sequence: Synthetic oligonucleotide
acatgcaactggttcaaacctttcaagtactaaattaaaacattcctttaaag

SEQ ID NO: 422369 - DNA, 52 bp, Artificial Sequence
  Description of Artificial Sequence: Synthetic oligonucleotide
catgcaactggttcaaacctttcaagtactaaattaaaacattcctttaaag

SEQ ID NO: 422370 - DNA, 55 bp, Artificial Sequence
  Description of Artificial Sequence: Synthetic oligonucleotide
atgcaactggttcaaacctttcaagtactaaattaaaacattcctttaaagaatg

SEQ ID NO: 422371 - DNA, 54 bp, Artificial Sequence
  Description of Artificial Sequence: Synthetic oligonucleotide
tgcaactggttcaaacctttcaagtactaaattaaaacattcctttaaagaatg

SEQ ID NO: 422372 - DNA, 53 bp, Artificial Sequence
  Description of Artificial Sequence: Synthetic oligonucleotide
gcaactggttcaaacctttcaagtactaaattaaaacattcctttaaagaatg

SEQ ID NO: 422373 - DNA, 60 bp, Artificial Sequence
  Description of Artificial Sequence: Synthetic oligonucleotide
caactggttcaaacctttcaagtactaaattaaaacattcctttaaagaatgaaattatt

SEQ ID NO: 422374 - DNA, 60 bp, Artificial Sequence
  Description of Artificial Sequence: Synthetic oligonucleotide
aactggttcaaacctttcaagtactaaattaaaacattcctttaaagaatgaaattattt

SEQ ID NO: 422375 - DNA, 60 bp, Artificial Sequence
  Description of Artificial Sequence: Synthetic oligonucleotide
actggttcaaacctttcaagtactaaattaaaacattcctttaaagaatgaaattatttc

SEQ ID NO: 422376 - DNA, 60 bp, Artificial Sequence
  Description of Artificial Sequence: Synthetic oligonucleotide
ctggttcaaacctttcaagtactaaattaaaacattcctttaaagaatgaaattatttca

SEQ ID NO: 422377 - DNA, 60 bp, Artificial Sequence
  Description of Artificial Sequence: Synthetic oligonucleotide
tggttcaaacctttcaagtactaaattaaaacattcctttaaagaatgaaattatttcag

SEQ ID NO: 422378 - DNA, 60 bp, Artificial Sequence
  Description of Artificial Sequence: Synthetic oligonucleotide
ggttcaaacctttcaagtactaaattaaaacattcctttaaagaatgaaattatttcaga

SEQ ID NO: 422379 - DNA, 60 bp, Artificial Sequence
  Description of Artificial Sequence: Synthetic oligonucleotide
gttcaaacctttcaagtactaaattaaaacattcctttaaagaatgaaattatttcagaa

SEQ ID NO: 422380 - DNA, 60 bp, Artificial Sequence
  Description of Artificial Sequence: Synthetic oligonucleotide
ttcaaacctttcaagtactaaattaaaacattcctttaaagaatgaaattatttcagaag

SEQ ID NO: 422381 - DNA, 60 bp, Artificial Sequence
  Description of Artificial Sequence: Synthetic oligonucleotide
tcaaacctttcaagtactaaattaaaacattcctttaaagaatgaaattatttcagaaga

SEQ ID NO: 422382 - DNA, 60 bp, Artificial Sequence
  Description of Artificial Sequence: Synthetic oligonucleotide
caaacctttcaagtactaaattaaaacattcctttaaagaatgaaattatttcagaagag

SEQ ID NO: 422383 - DNA, 60 bp, Artificial Sequence
  Description of Artificial Sequence: Synthetic oligonucleotide
aaacctttcaagtactaaattaaaacattcctttaaagaatgaaattatttcagaagagg

SEQ ID NO: 422384 - DNA, 60 bp, Artificial Sequence
  Description of Artificial Sequence: Synthetic oligonucleotide
aacctttcaagtactaaattaaaacattcctttaaagaatgaaattatttcagaagagga

SEQ ID NO: 422385 - DNA, 60 bp, Artificial Sequence
  Description of Artificial Sequence: Synthetic oligonucleotide
acctttcaagtactaaattaaaacattcctttaaagaatgaaattatttcagaagaggac

SEQ ID NO: 422386 - DNA, 59 bp, Artificial Sequence
  Description of Artificial Sequence: Synthetic oligonucleotide
cctttcaagtactaaattaaaacattcctttaaagaatgaaattatttcagaagaggac

SEQ ID NO: 422387 - DNA, 59 bp, Artificial Sequence
  Description of Artificial Sequence: Synthetic oligonucleotide
ctttcaagtactaaattaaaacattcctttaaagaatgaaattatttcagaagaggacc

SEQ ID NO: 422388 - DNA, 60 bp, Artificial Sequence
  Description of Artificial Sequence: Synthetic oligonucleotide
tttcaagtactaaattaaaacattcctttaaagaatgaaattatttcagaagaggacctt

SEQ ID NO: 422389 - DNA, 60 bp, Artificial Sequence
  Description of Artificial Sequence: Synthetic oligonucleotide
ttcaagtactaaattaaaacattcctttaaagaatgaaattatttcagaagaggaccttc

SEQ ID NO: 422390 - DNA, 59 bp, Artificial Sequence
  Description of Artificial Sequence: Synthetic oligonucleotide
tcaagtactaaattaaaacattcctttaaagaatgaaattatttcagaagaggaccttc

SEQ ID NO: 422391 - DNA, 58 bp, Artificial Sequence
  Description of Artificial Sequence: Synthetic oligonucleotide
caagtactaaattaaaacattcctttaaagaatgaaattatttcagaagaggaccttc

SEQ ID NO: 422392 - DNA, 60 bp, Artificial Sequence
  Description of Artificial Sequence: Synthetic oligonucleotide
aagtactaaattaaaacattcctttaaagaatgaaattatttcagaagaggaccttcata

SEQ ID NO: 422393 - DNA, 60 bp, Artificial Sequence
  Description of Artificial Sequence: Synthetic oligonucleotide
agtactaaattaaaacattcctttaaagaatgaaattatttcagaagaggaccttcatac

SEQ ID NO: 422394 - DNA, 59 bp, Artificial Sequence
  Description of Artificial Sequence: Synthetic oligonucleotide
gtactaaattaaaacattcctttaaagaatgaaattatttcagaagaggaccttcatac

SEQ ID NO: 422395 - DNA, 60 bp, Artificial Sequence
  Description of Artificial Sequence: Synthetic oligonucleotide
tactaaattaaaacattcctttaaagaatgaaattatttcagaagaggaccttcatacag

SEQ ID NO: 422396 - DNA, 59 bp, Artificial Sequence
  Description of Artificial Sequence: Synthetic oligonucleotide
actaaattaaaacattcctttaaagaatgaaattatttcagaagaggaccttcatacag

SEQ ID NO: 422397 - DNA, 58 bp, Artificial Sequence
  Description of Artificial Sequence: Synthetic oligonucleotide
ctaaattaaaacattcctttaaagaatgaaattatttcagaagaggaccttcatacag

SEQ ID NO: 422398 - DNA, 58 bp, Artificial Sequence
  Description of Artificial Sequence: Synthetic oligonucleotide
taaattaaaacattcctttaaagaatgaaattatttcagaagaggaccttcatacagc

SEQ ID NO: 422399 - DNA, 57 bp, Artificial Sequence
  Description of Artificial Sequence: Synthetic oligonucleotide
aaattaaaacattcctttaaagaatgaaattatttcagaagaggaccttcatacagc

SEQ ID NO: 422400 - DNA, 56 bp, Artificial Sequence
  Description of Artificial Sequence: Synthetic oligonucleotide
aattaaaacattcctttaaagaatgaaattatttcagaagaggaccttcatacagc

SEQ ID NO: 422401 - DNA, 55 bp, Artificial Sequence
  Description of Artificial Sequence: Synthetic oligonucleotide
attaaaacattcctttaaagaatgaaattatttcagaagaggaccttcatacagc

SEQ ID NO: 422402 - DNA, 54 bp, Artificial Sequence
  Description of Artificial Sequence: Synthetic oligonucleotide
ttaaaacattcctttaaagaatgaaattatttcagaagaggaccttcatacagc

SEQ ID NO: 422403 - DNA, 53 bp, Artificial Sequence
  Description of Artificial Sequence: Synthetic oligonucleotide
taaaacattcctttaaagaatgaaattatttcagaagaggaccttcatacagc

SEQ ID NO: 422404 - DNA, 52 bp, Artificial Sequence
  Description of Artificial Sequence: Synthetic oligonucleotide
aaaacattcctttaaagaatgaaattatttcagaagaggaccttcatacagc

SEQ ID NO: 422405 - DNA, 51 bp, Artificial Sequence
  Description of Artificial Sequence: Synthetic oligonucleotide
aaacattcctttaaagaatgaaattatttcagaagaggaccttcatacagc

SEQ ID NO: 422406 - DNA, 50 bp, Artificial Sequence
  Description of Artificial Sequence: Synthetic oligonucleotide
aacattcctttaaagaatgaaattatttcagaagaggaccttcatacagc

SEQ ID NO: 422407 - DNA, 49 bp, Artificial Sequence
  Description of Artificial Sequence: Synthetic oligonucleotide
acattcctttaaagaatgaaattatttcagaagaggaccttcatacagc

SEQ ID NO: 422408 - DNA, 48 bp, Artificial Sequence
  Description of Artificial Sequence: Synthetic oligonucleotide
cattcctttaaagaatgaaattatttcagaagaggaccttcatacagc

SEQ ID NO: 422409 - DNA, 50 bp, Artificial Sequence
  Description of Artificial Sequence: Synthetic oligonucleotide
attcctttaaagaatgaaattatttcagaagaggaccttcatacagcatc

SEQ ID NO: 422410 - DNA, 49 bp, Artificial Sequence
  Description of Artificial Sequence: Synthetic oligonucleotide
ttcctttaaagaatgaaattatttcagaagaggaccttcatacagcatc

SEQ ID NO: 422411 - DNA, 48 bp, Artificial Sequence
  Description of Artificial Sequence: Synthetic oligonucleotide
tcctttaaagaatgaaattatttcagaagaggaccttcatacagcatc

SEQ ID NO: 422412 - DNA, 47 bp, Artificial Sequence
  Description of Artificial Sequence: Synthetic oligonucleotide
cctttaaagaatgaaattatttcagaagaggaccttcatacagcatc

SEQ ID NO: 422413 - DNA, 48 bp, Artificial Sequence
  Description of Artificial Sequence: Synthetic oligonucleotide
ctttaaagaatgaaattatttcagaagaggaccttcatacagcatctc

SEQ ID NO: 422414 - DNA, 49 bp, Artificial Sequence
  Description of Artificial Sequence: Synthetic oligonucleotide
tttaaagaatgaaattatttcagaagaggaccttcatacagcatctctg

SEQ ID NO: 422415 - DNA, 48 bp, Artificial Sequence
  Description of Artificial Sequence: Synthetic oligonucleotide
ttaaagaatgaaattatttcagaagaggaccttcatacagcatctctg

SEQ ID NO: 422416 - DNA, 47 bp, Artificial Sequence
  Description of Artificial Sequence: Synthetic oligonucleotide
taaagaatgaaattatttcagaagaggaccttcatacagcatctctg

SEQ ID NO: 422417 - DNA, 46 bp, Artificial Sequence
  Description of Artificial Sequence: Synthetic oligonucleotide
aaagaatgaaattatttcagaagaggaccttcatacagcatctctg

SEQ ID NO: 422418 - DNA, 45 bp, Artificial Sequence
  Description of Artificial Sequence: Synthetic oligonucleotide
aagaatgaaattatttcagaagaggaccttcatacagcatctctg

SEQ ID NO: 422419 - DNA, 44 bp, Artificial Sequence
  Description of Artificial Sequence: Synthetic oligonucleotide
agaatgaaattatttcagaagaggaccttcatacagcatctctg

SEQ ID NO: 422420 - DNA, 43 bp, Artificial Sequence
  Description of Artificial Sequence: Synthetic oligonucleotide
gaatgaaattatttcagaagaggaccttcatacagcatctctg

SEQ ID NO: 422421 - DNA, 44 bp, Artificial Sequence
  Description of Artificial Sequence: Synthetic oligonucleotide
aatgaaattatttcagaagaggaccttcatacagcatctctgag

SEQ ID NO: 422422 - DNA, 43 bp, Artificial Sequence
  Description of Artificial Sequence: Synthetic oligonucleotide
atgaaattatttcagaagaggaccttcatacagcatctctgag

SEQ ID NO: 422423 - DNA, 42 bp, Artificial Sequence
  Description of Artificial Sequence: Synthetic oligonucleotide
tgaaattatttcagaagaggaccttcatacagcatctctgag

SEQ ID NO: 422424 - DNA, 41 bp, Artificial Sequence
  Description of Artificial Sequence: Synthetic oligonucleotide
gaaattatttcagaagaggaccttcatacagcatctctgag

SEQ ID NO: 422425 - DNA, 41 bp, Artificial Sequence
  Description of Artificial Sequence: Synthetic oligonucleotide
aaattatttcagaagaggaccttcatacagcatctctgagc

SEQ ID NO: 422426 - DNA, 40 bp, Artificial Sequence
  Description of Artificial Sequence: Synthetic oligonucleotide
aattatttcagaagaggaccttcatacagcatctctgagc

SEQ ID NO: 422427 - DNA, 39 bp, Artificial Sequence
  Description of Artificial Sequence: Synthetic oligonucleotide
attatttcagaagaggaccttcatacagcatctctgagc

SEQ ID NO: 422428 - DNA, 38 bp, Artificial Sequence
  Description of Artificial Sequence: Synthetic oligonucleotide
ttatttcagaagaggaccttcatacagcatctctgagc

SEQ ID NO: 422429 - DNA, 37 bp, Artificial Sequence
  Description of Artificial Sequence: Synthetic oligonucleotide
tatttcagaagaggaccttcatacagcatctctgagc

SEQ ID NO: 422430 - DNA, 36 bp, Artificial Sequence
  Description of Artificial Sequence: Synthetic oligonucleotide
atttcagaagaggaccttcatacagcatctctgagc

SEQ ID NO: 422431 - DNA, 35 bp, Artificial Sequence
  Description of Artificial Sequence: Synthetic oligonucleotide
tttcagaagaggaccttcatacagcatctctgagc

SEQ ID NO: 422432 - DNA, 34 bp, Artificial Sequence
  Description of Artificial Sequence: Synthetic oligonucleotide
ttcagaagaggaccttcatacagcatctctgagc

SEQ ID NO: 422433 - DNA, 33 bp, Artificial Sequence
  Description of Artificial Sequence: Synthetic oligonucleotide
tcagaagaggaccttcatacagcatctctgagc

SEQ ID NO: 422434 - DNA, 32 bp, Artificial Sequence
  Description of Artificial Sequence: Synthetic oligonucleotide
cagaagaggaccttcatacagcatctctgagc

SEQ ID NO: 422435 - DNA, 33 bp, Artificial Sequence
  Description of Artificial Sequence: Synthetic oligonucleotide
agaagaggaccttcatacagcatctctgagcag

SEQ ID NO: 422436 - DNA, 32 bp, Artificial Sequence
  Description of Artificial Sequence: Synthetic oligonucleotide
gaagaggaccttcatacagcatctctgagcag

SEQ ID NO: 422437 - DNA, 32 bp, Artificial Sequence
  Description of Artificial Sequence: Synthetic oligonucleotide
aagaggaccttcatacagcatctctgagcagc

SEQ ID NO: 422438 - DNA, 31 bp, Artificial Sequence
  Description of Artificial Sequence: Synthetic oligonucleotide
agaggaccttcatacagcatctctgagcagc

SEQ ID NO: 422439 - DNA, 30 bp, Artificial Sequence
  Description of Artificial Sequence: Synthetic oligonucleotide
gaggaccttcatacagcatctctgagcagc

SEQ ID NO: 422440 - DNA, 32 bp, Artificial Sequence
  Description of Artificial Sequence: Synthetic oligonucleotide
aggaccttcatacagcatctctgagcagcaac

SEQ ID NO: 422441 - DNA, 31 bp, Artificial Sequence
  Description of Artificial Sequence: Synthetic oligonucleotide
ggaccttcatacagcatctctgagcagcaac

SEQ ID NO: 422442 - DNA, 32 bp, Artificial Sequence
  Description of Artificial Sequence: Synthetic oligonucleotide
gaccttcatacagcatctctgagcagcaactg

SEQ ID NO: 422443 - DNA, 34 bp, Artificial Sequence
  Description of Artificial Sequence: Synthetic oligonucleotide
accttcatacagcatctctgagcagcaactgatg

SEQ ID NO: 422444 - DNA, 33 bp, Artificial Sequence
  Description of Artificial Sequence: Synthetic oligonucleotide
ccttcatacagcatctctgagcagcaactgatg

SEQ ID NO: 422445 - DNA, 35 bp, Artificial Sequence
  Description of Artificial Sequence: Synthetic oligonucleotide
cttcatacagcatctctgagcagcaactgatgatg

SEQ ID NO: 422446 - DNA, 35 bp, Artificial Sequence
  Description of Artificial Sequence: Synthetic oligonucleotide
ttcatacagcatctctgagcagcaactgatgatgc

SEQ ID NO: 422447 - DNA, 34 bp, Artificial Sequence
  Description of Artificial Sequence: Synthetic oligonucleotide
tcatacagcatctctgagcagcaactgatgatgc

SEQ ID NO: 422448 - DNA, 33 bp, Artificial Sequence
  Description of Artificial Sequence: Synthetic oligonucleotide
catacagcatctctgagcagcaactgatgatgc

SEQ ID NO: 422449 - DNA, 34 bp, Artificial Sequence
  Description of Artificial Sequence: Synthetic oligonucleotide
atacagcatctctgagcagcaactgatgatgctg

SEQ ID NO: 422450 - DNA, 33 bp, Artificial Sequence
  Description of Artificial Sequence: Synthetic oligonucleotide
tacagcatctctgagcagcaactgatgatgctg

SEQ ID NO: 422451 - DNA, 32 bp, Artificial Sequence
  Description of Artificial Sequence: Synthetic oligonucleotide
acagcatctctgagcagcaactgatgatgctg

SEQ ID NO: 422452 - DNA, 31 bp, Artificial Sequence
  Description of Artificial Sequence: Synthetic oligonucleotide
cagcatctctgagcagcaactgatgatgctg

SEQ ID NO: 422453 - DNA, 33 bp, Artificial Sequence
  Description of Artificial Sequence: Synthetic oligonucleotide
agcatctctgagcagcaactgatgatgctgttg

SEQ ID NO: 422454 - DNA, 32 bp, Artificial Sequence
  Description of Artificial Sequence: Synthetic oligonucleotide
gcatctctgagcagcaactgatgatgctgttg

SEQ ID NO: 422455 - DNA, 34 bp, Artificial Sequence
  Description of Artificial Sequence: Synthetic oligonucleotide
catctctgagcagcaactgatgatgctgttgaac

SEQ ID NO: 422456 - DNA, 35 bp, Artificial Sequence
  Description of Artificial Sequence: Synthetic oligonucleotide
atctctgagcagcaactgatgatgctgttgaactc

SEQ ID NO: 422457 - DNA, 34 bp, Artificial Sequence
  Description of Artificial Sequence: Synthetic oligonucleotide
tctctgagcagcaactgatgatgctgttgaactc

SEQ ID NO: 422458 - DNA, 33 bp, Artificial Sequence
  Description of Artificial Sequence: Synthetic oligonucleotide
ctctgagcagcaactgatgatgctgttgaactc

SEQ ID NO: 422459 - DNA, 34 bp, Artificial Sequence
  Description of Artificial Sequence: Synthetic oligonucleotide
tctgagcagcaactgatgatgctgttgaactcag

SEQ ID NO: 422460 - DNA, 33 bp, Artificial Sequence
  Description of Artificial Sequence: Synthetic oligonucleotide
ctgagcagcaactgatgatgctgttgaactcag

SEQ ID NO: 422461 - DNA, 35 bp, Artificial Sequence
  Description of Artificial Sequence: Synthetic oligonucleotide
tgagcagcaactgatgatgctgttgaactcagatg

SEQ ID NO: 422462 - DNA, 34 bp, Artificial Sequence
  Description of Artificial Sequence: Synthetic oligonucleotide
gagcagcaactgatgatgctgttgaactcagatg

SEQ ID NO: 422463 - DNA, 34 bp, Artificial Sequence
  Description of Artificial Sequence: Synthetic oligonucleotide
agcagcaactgatgatgctgttgaactcagatgc

SEQ ID NO: 422464 - DNA, 33 bp, Artificial Sequence
  Description of Artificial Sequence: Synthetic oligonucleotide
gcagcaactgatgatgctgttgaactcagatgc

SEQ ID NO: 422465 - DNA, 34 bp, Artificial Sequence
  Description of Artificial Sequence: Synthetic oligonucleotide
cagcaactgatgatgctgttgaactcagatgctg

SEQ ID NO: 422466 - DNA, 37 bp, Artificial Sequence
  Description of Artificial Sequence: Synthetic oligonucleotide
agcaactgatgatgctgttgaactcagatgctgattg

SEQ ID NO: 422467 - DNA, 36 bp, Artificial Sequence
  Description of Artificial Sequence: Synthetic oligonucleotide
gcaactgatgatgctgttgaactcagatgctgattg

SEQ ID NO: 422468 - DNA, 36 bp, Artificial Sequence
  Description of Artificial Sequence: Synthetic oligonucleotide
caactgatgatgctgttgaactcagatgctgattgg

SEQ ID NO: 422469 - DNA, 38 bp, Artificial Sequence
  Description of Artificial Sequence: Synthetic oligonucleotide
aactgatgatgctgttgaactcagatgctgattggttc

SEQ ID NO: 422470 - DNA, 37 bp, Artificial Sequence
  Description of Artificial Sequence: Synthetic oligonucleotide
actgatgatgctgttgaactcagatgctgattggttc

SEQ ID NO: 422471 - DNA, 36 bp, Artificial Sequence
  Description of Artificial Sequence: Synthetic oligonucleotide
ctgatgatgctgttgaactcagatgctgattggttc

SEQ ID NO: 422472 - DNA, 37 bp, Artificial Sequence
  Description of Artificial Sequence: Synthetic oligonucleotide
tgatgatgctgttgaactcagatgctgattggttctc

SEQ ID NO: 422473 - DNA, 36 bp, Artificial Sequence
  Description of Artificial Sequence: Synthetic oligonucleotide
gatgatgctgttgaactcagatgctgattggttctc

SEQ ID NO: 422474 - DNA, 36 bp, Artificial Sequence
  Description of Artificial Sequence: Synthetic oligonucleotide
atgatgctgttgaactcagatgctgattggttctcc

SEQ ID NO: 422475 - DNA, 35 bp, Artificial Sequence
  Description of Artificial Sequence: Synthetic oligonucleotide
tgatgctgttgaactcagatgctgattggttctcc

SEQ ID NO: 422476 - DNA, 34 bp, Artificial Sequence
  Description of Artificial Sequence: Synthetic oligonucleotide
gatgctgttgaactcagatgctgattggttctcc

SEQ ID NO: 422477 - DNA, 34 bp, Artificial Sequence
  Description of Artificial Sequence: Synthetic oligonucleotide
atgctgttgaactcagatgctgattggttctccg

SEQ ID NO: 422478 - DNA, 33 bp, Artificial Sequence
  Description of Artificial Sequence: Synthetic oligonucleotide
tgctgttgaactcagatgctgattggttctccg

SEQ ID NO: 422479 - DNA, 32 bp, Artificial Sequence
  Description of Artificial Sequence: Synthetic oligonucleotide
gctgttgaactcagatgctgattggttctccg

SEQ ID NO: 422480 - DNA, 33 bp, Artificial Sequence
  Description of Artificial Sequence: Synthetic oligonucleotide
ctgttgaactcagatgctgattggttctccgac

SEQ ID NO: 422481 - DNA, 34 bp, Artificial Sequence
  Description of Artificial Sequence: Synthetic oligonucleotide
tgttgaactcagatgctgattggttctccgacac

SEQ ID NO: 422482 - DNA, 33 bp, Artificial Sequence
  Description of Artificial Sequence: Synthetic oligonucleotide
gttgaactcagatgctgattggttctccgacac

SEQ ID NO: 422483 - DNA, 33 bp, Artificial Sequence
  Description of Artificial Sequence: Synthetic oligonucleotide
ttgaactcagatgctgattggttctccgacacg

SEQ ID NO: 422484 - DNA, 32 bp, Artificial Sequence
  Description of Artificial Sequence: Synthetic oligonucleotide
tgaactcagatgctgattggttctccgacacg

SEQ ID NO: 422485 - DNA, 31 bp, Artificial Sequence
  Description of Artificial Sequence: Synthetic oligonucleotide
gaactcagatgctgattggttctccgacacg

SEQ ID NO: 422486 - DNA, 32 bp, Artificial Sequence
  Description of Artificial Sequence: Synthetic oligonucleotide
aactcagatgctgattggttctccgacacgag

SEQ ID NO: 422487 - DNA, 31 bp, Artificial Sequence
  Description of Artificial Sequence: Synthetic oligonucleotide
actcagatgctgattggttctccgacacgag

SEQ ID NO: 422488 - DNA, 30 bp, Artificial Sequence
  Description of Artificial Sequence: Synthetic oligonucleotide
ctcagatgctgattggttctccgacacgag

SEQ ID NO: 422489 - DNA, 34 bp, Artificial Sequence
  Description of Artificial Sequence: Synthetic oligonucleotide
tcagatgctgattggttctccgacacgagattac

SEQ ID NO: 422490 - DNA, 33 bp, Artificial Sequence
  Description of Artificial Sequence: Synthetic oligonucleotide
cagatgctgattggttctccgacacgagattac

SEQ ID NO: 422491 - DNA, 33 bp, Artificial Sequence
  Description of Artificial Sequence: Synthetic oligonucleotide
agatgctgattggttctccgacacgagattacc

SEQ ID NO: 422492 - DNA, 32 bp, Artificial Sequence
  Description of Artificial Sequence: Synthetic oligonucleotide
gatgctgattggttctccgacacgagattacc

SEQ ID NO: 422493 - DNA, 32 bp, Artificial Sequence
  Description of Artificial Sequence: Synthetic oligonucleotide
atgctgattggttctccgacacgagattaccc

SEQ ID NO: 422494 - DNA, 31 bp, Artificial Sequence
  Description of Artificial Sequence: Synthetic oligonucleotide
tgctgattggttctccgacacgagattaccc

SEQ ID NO: 422495 - DNA, 30 bp, Artificial Sequence
  Description of Artificial Sequence: Synthetic oligonucleotide
gctgattggttctccgacacgagattaccc

SEQ ID NO: 422496 - DNA, 33 bp, Artificial Sequence
  Description of Artificial Sequence: Synthetic oligonucleotide
ctgattggttctccgacacgagattacccaatc

SEQ ID NO: 422497 - DNA, 33 bp, Artificial Sequence
  Description of Artificial Sequence: Synthetic oligonucleotide
tgattggttctccgacacgagattacccaatcc

SEQ ID NO: 422498 - DNA, 32 bp, Artificial Sequence
  Description of Artificial Sequence: Synthetic oligonucleotide
gattggttctccgacacgagattacccaatcc

SEQ ID NO: 422499 - DNA, 33 bp, Artificial Sequence
  Description of Artificial Sequence: Synthetic oligonucleotide
attggttctccgacacgagattacccaatccag

SEQ ID NO: 422500 - DNA, 32 bp, Artificial Sequence
  Description of Artificial Sequence: Synthetic oligonucleotide
ttggttctccgacacgagattacccaatccag

SEQ ID NO: 422501 - DNA, 31 bp, Artificial Sequence
  Description of Artificial Sequence: Synthetic oligonucleotide
tggttctccgacacgagattacccaatccag

SEQ ID NO: 422502 - DNA, 30 bp, Artificial Sequence
  Description of Artificial Sequence: Synthetic oligonucleotide
ggttctccgacacgagattacccaatccag

SEQ ID NO: 422503 - DNA, 30 bp, Artificial Sequence
  Description of Artificial Sequence: Synthetic oligonucleotide
gttctccgacacgagattacccaatccagg

SEQ ID NO: 422504 - DNA, 31 bp, Artificial Sequence
  Description of Artificial Sequence: Synthetic oligonucleotide
ttctccgacacgagattacccaatccaggag

SEQ ID NO: 422505 - DNA, 30 bp, Artificial Sequence
  Description of Artificial Sequence: Synthetic oligonucleotide
tctccgacacgagattacccaatccaggag

SEQ ID NO: 422506 - DNA, 29 bp, Artificial Sequence
  Description of Artificial Sequence: Synthetic oligonucleotide
ctccgacacgagattacccaatccaggag

SEQ ID NO: 422507 - DNA, 29 bp, Artificial Sequence
  Description of Artificial Sequence: Synthetic oligonucleotide
tccgacacgagattacccaatccaggagc

SEQ ID NO: 422508 - DNA, 28 bp, Artificial Sequence
  Description of Artificial Sequence: Synthetic oligonucleotide
ccgacacgagattacccaatccaggagc

SEQ ID NO: 422509 - DNA, 30 bp, Artificial Sequence
  Description of Artificial Sequence: Synthetic oligonucleotide
cgacacgagattacccaatccaggagcaag

SEQ ID NO: 422510 - DNA, 30 bp, Artificial Sequence
  Description of Artificial Sequence: Synthetic oligonucleotide
gacacgagattacccaatccaggagcaagg

SEQ ID NO: 422511 - DNA, 34 bp, Artificial Sequence
  Description of Artificial Sequence: Synthetic oligonucleotide
acacgagattacccaatccaggagcaaggaaatc

SEQ ID NO: 422512 - DNA, 33 bp, Artificial Sequence
  Description of Artificial Sequence: Synthetic oligonucleotide
cacgagattacccaatccaggagcaaggaaatc

SEQ ID NO: 422513 - DNA, 34 bp, Artificial Sequence
  Description of Artificial Sequence: Synthetic oligonucleotide
acgagattacccaatccaggagcaaggaaatcag

SEQ ID NO: 422514 - DNA, 33 bp, Artificial Sequence
  Description of Artificial Sequence: Synthetic oligonucleotide
cgagattacccaatccaggagcaaggaaatcag

SEQ ID NO: 422515 - DNA, 36 bp, Artificial Sequence
  Description of Artificial Sequence: Synthetic oligonucleotide
gagattacccaatccaggagcaaggaaatcagtaac

SEQ ID NO: 422516 - DNA, 38 bp, Artificial Sequence
  Description of Artificial Sequence: Synthetic oligonucleotide
agattacccaatccaggagcaaggaaatcagtaacttc

SEQ ID NO: 422517 - DNA, 37 bp, Artificial Sequence
  Description of Artificial Sequence: Synthetic oligonucleotide
gattacccaatccaggagcaaggaaatcagtaacttc

SEQ ID NO: 422518 - DNA, 37 bp, Artificial Sequence
  Description of Artificial Sequence: Synthetic oligonucleotide
attacccaatccaggagcaaggaaatcagtaacttcc

SEQ ID NO: 422519 - DNA, 36 bp, Artificial Sequence
  Description of Artificial Sequence: Synthetic oligonucleotide
ttacccaatccaggagcaaggaaatcagtaacttcc

SEQ ID NO: 422520 - DNA, 35 bp, Artificial Sequence
  Description of Artificial Sequence: Synthetic oligonucleotide
tacccaatccaggagcaaggaaatcagtaacttcc

SEQ ID NO: 422521 - DNA, 34 bp, Artificial Sequence
  Description of Artificial Sequence: Synthetic oligonucleotide
acccaatccaggagcaaggaaatcagtaacttcc

SEQ ID NO: 422522 - DNA, 33 bp, Artificial Sequence
  Description of Artificial Sequence: Synthetic oligonucleotide
cccaatccaggagcaaggaaatcagtaacttcc

SEQ ID NO: 422523 - DNA, 34 bp, Artificial Sequence
  Description of Artificial Sequence: Synthetic oligonucleotide
ccaatccaggagcaaggaaatcagtaacttcctc

SEQ ID NO: 422524 - DNA, 34 bp, Artificial Sequence
  Description of Artificial Sequence: Synthetic oligonucleotide
caatccaggagcaaggaaatcagtaacttcctcc

SEQ ID NO: 422525 - DNA, 34 bp, Artificial Sequence
  Description of Artificial Sequence: Synthetic oligonucleotide
aatccaggagcaaggaaatcagtaacttcctccc

SEQ ID NO: 422526 - DNA, 33 bp, Artificial Sequence
  Description of Artificial Sequence: Synthetic oligonucleotide
atccaggagcaaggaaatcagtaacttcctccc

SEQ ID NO: 422527 - DNA, 32 bp, Artificial Sequence
  Description of Artificial Sequence: Synthetic oligonucleotide
tccaggagcaaggaaatcagtaacttcctccc

SEQ ID NO: 422528 - DNA, 39 bp, Artificial Sequence
  Description of Artificial Sequence: Synthetic oligonucleotide
caggagcaaggaaatcagtaacttcctccctataatttg

SEQ ID NO: 422529 - DNA, 39 bp, Artificial Sequence
  Description of Artificial Sequence: Synthetic oligonucleotide
aggagcaaggaaatcagtaacttcctccctataatttgg

SEQ ID NO: 422530 - DNA, 38 bp, Artificial Sequence
  Description of Artificial Sequence: Synthetic oligonucleotide
ggagcaaggaaatcagtaacttcctccctataatttgg

SEQ ID NO: 422531 - DNA, 41 bp, Artificial Sequence
  Description of Artificial Sequence: Synthetic oligonucleotide
gagcaaggaaatcagtaacttcctccctataatttggaatg

SEQ ID NO: 422532 - DNA, 42 bp, Artificial Sequence
  Description of Artificial Sequence: Synthetic oligonucleotide
agcaaggaaatcagtaacttcctccctataatttggaatgtg

SEQ ID NO: 422533 - DNA, 41 bp, Artificial Sequence
  Description of Artificial Sequence: Synthetic oligonucleotide
gcaaggaaatcagtaacttcctccctataatttggaatgtg

SEQ ID NO: 422534 - DNA, 41 bp, Artificial Sequence
  Description of Artificial Sequence: Synthetic oligonucleotide
caaggaaatcagtaacttcctccctataatttggaatgtgg

SEQ ID NO: 422535 - DNA, 41 bp, Artificial Sequence
  Description of Artificial Sequence: Synthetic oligonucleotide
aaggaaatcagtaacttcctccctataatttggaatgtggg

SEQ ID NO: 422536 - DNA, 40 bp, Artificial Sequence
  Description of Artificial Sequence: Synthetic oligonucleotide
aggaaatcagtaacttcctccctataatttggaatgtggg

SEQ ID NO: 422537 - DNA, 39 bp, Artificial Sequence
  Description of Artificial Sequence: Synthetic oligonucleotide
ggaaatcagtaacttcctccctataatttggaatgtggg

SEQ ID NO: 422538 - DNA, 40 bp, Artificial Sequence
  Description of Artificial Sequence: Synthetic oligonucleotide
gaaatcagtaacttcctccctataatttggaatgtgggtg

SEQ ID NO: 422539 - DNA, 40 bp, Artificial Sequence
  Description of Artificial Sequence: Synthetic oligonucleotide
aaatcagtaacttcctccctataatttggaatgtgggtgg

SEQ ID NO: 422540 - DNA, 39 bp, Artificial Sequence
  Description of Artificial Sequence: Synthetic oligonucleotide
aatcagtaacttcctccctataatttggaatgtgggtgg

SEQ ID NO: 422541 - DNA, 38 bp, Artificial Sequence
  Description of Artificial Sequence: Synthetic oligonucleotide
atcagtaacttcctccctataatttggaatgtgggtgg

SEQ ID NO: 422542 - DNA, 37 bp, Artificial Sequence
  Description of Artificial Sequence: Synthetic oligonucleotide
tcagtaacttcctccctataatttggaatgtgggtgg

SEQ ID NO: 422543 - DNA, 36 bp, Artificial Sequence
  Description of Artificial Sequence: Synthetic oligonucleotide
cagtaacttcctccctataatttggaatgtgggtgg

SEQ ID NO: 422544 - DNA, 37 bp, Artificial Sequence
  Description of Artificial Sequence: Synthetic oligonucleotide
agtaacttcctccctataatttggaatgtgggtggag

SEQ ID NO: 422545 - DNA, 36 bp, Artificial Sequence
  Description of Artificial Sequence: Synthetic oligonucleotide
gtaacttcctccctataatttggaatgtgggtggag

SEQ ID NO: 422546 - DNA, 36 bp, Artificial Sequence
  Description of Artificial Sequence: Synthetic oligonucleotide
taacttcctccctataatttggaatgtgggtggagg

SEQ ID NO: 422547 - DNA, 35 bp, Artificial Sequence
  Description of Artificial Sequence: Synthetic oligonucleotide
aacttcctccctataatttggaatgtgggtggagg

SEQ ID NO: 422548 - DNA, 34 bp, Artificial Sequence
  Description of Artificial Sequence: Synthetic oligonucleotide
acttcctccctataatttggaatgtgggtggagg

SEQ ID NO: 422549 - DNA, 33 bp, Artificial Sequence
  Description of Artificial Sequence: Synthetic oligonucleotide
cttcctccctataatttggaatgtgggtggagg

SEQ ID NO: 422550 - DNA, 33 bp, Artificial Sequence
  Description of Artificial Sequence: Synthetic oligonucleotide
ttcctccctataatttggaatgtgggtggaggg

SEQ ID NO: 422551 - DNA, 32 bp, Artificial Sequence
  Description of Artificial Sequence: Synthetic oligonucleotide
tcctccctataatttggaatgtgggtggaggg

SEQ ID NO: 422552 - DNA, 31 bp, Artificial Sequence
  Description of Artificial Sequence: Synthetic oligonucleotide
cctccctataatttggaatgtgggtggaggg

SEQ ID NO: 422553 - DNA, 31 bp, Artificial Sequence
  Description of Artificial Sequence: Synthetic oligonucleotide
ctccctataatttggaatgtgggtggagggg

SEQ ID NO: 422554 - DNA, 31 bp, Artificial Sequence
  Description of Artificial Sequence: Synthetic oligonucleotide
tccctataatttggaatgtgggtggaggggg

SEQ ID NO: 422555 - DNA, 30 bp, Artificial Sequence
  Description of Artificial Sequence: Synthetic oligonucleotide
ccctataatttggaatgtgggtggaggggg

SEQ ID NO: 422556 - DNA, 30 bp, Artificial Sequence
  Description of Artificial Sequence: Synthetic oligonucleotide
cctataatttggaatgtgggtggagggggg

SEQ ID NO: 422557 - DNA, 31 bp, Artificial Sequence
  Description of Artificial Sequence: Synthetic oligonucleotide
ctataatttggaatgtgggtggaggggggtc

SEQ ID NO: 422558 - DNA, 34 bp, Artificial Sequence
  Description of Artificial Sequence: Synthetic oligonucleotide
tataatttggaatgtgggtggaggggggtcatag

SEQ ID NO: 422559 - DNA, 33 bp, Artificial Sequence
  Description of Artificial Sequence: Synthetic oligonucleotide
ataatttggaatgtgggtggaggggggtcatag

SEQ ID NO: 422560 - DNA, 32 bp, Artificial Sequence
  Description of Artificial Sequence: Synthetic oligonucleotide
taatttggaatgtgggtggaggggggtcatag

SEQ ID NO: 422561 - DNA, 31 bp, Artificial Sequence
  Description of Artificial Sequence: Synthetic oligonucleotide
aatttggaatgtgggtggaggggggtcatag

SEQ ID NO: 422562 - DNA, 30 bp, Artificial Sequence
  Description of Artificial Sequence: Synthetic oligonucleotide
atttggaatgtgggtggaggggggtcatag

SEQ ID NO: 422563 - DNA, 29 bp, Artificial Sequence
  Description of Artificial Sequence: Synthetic oligonucleotide
tttggaatgtgggtggaggggggtcatag

SEQ ID NO: 422564 - DNA, 28 bp, Artificial Sequence
  Description of Artificial Sequence: Synthetic oligonucleotide
ttggaatgtgggtggaggggggtcatag

SEQ ID NO: 422565 - DNA, 27 bp, Artificial Sequence
  Description of Artificial Sequence: Synthetic oligonucleotide
tggaatgtgggtggaggggggtcatag

SEQ ID NO: 422566 - DNA, 27 bp, Artificial Sequence
  Description of Artificial Sequence: Synthetic oligonucleotide
ggaatgtgggtggaggggggtcatagt

SEQ ID NO: 422567 - DNA, 28 bp, Artificial Sequence
  Description of Artificial Sequence: Synthetic oligonucleotide
gaatgtgggtggaggggggtcatagttc

SEQ ID NO: 422568 - DNA, 29 bp, Artificial Sequence
  Description of Artificial Sequence: Synthetic oligonucleotide
aatgtgggtggaggggggtcatagttctc

SEQ ID NO: 422569 - DNA, 28 bp, Artificial Sequence
  Description of Artificial Sequence: Synthetic oligonucleotide
atgtgggtggaggggggtcatagttctc

SEQ ID NO: 422570 - DNA, 27 bp, Artificial Sequence
  Description of Artificial Sequence: Synthetic oligonucleotide
tgtgggtggaggggggtcatagttctc

SEQ ID NO: 422571 - DNA, 26 bp, Artificial Sequence
  Description of Artificial Sequence: Synthetic oligonucleotide
gtgggtggaggggggtcatagttctc

SEQ ID NO: 422572 - DNA, 26 bp, Artificial Sequence
  Description of Artificial Sequence: Synthetic oligonucleotide
tgggtggaggggggtcatagttctcc

SEQ ID NO: 422573 - DNA, 25 bp, Artificial Sequence
  Description of Artificial Sequence: Synthetic oligonucleotide
gggtggaggggggtcatagttctcc

SEQ ID NO: 422574 - DNA, 26 bp, Artificial Sequence
  Description of Artificial Sequence: Synthetic oligonucleotide
ggtggaggggggtcatagttctccct

SEQ ID NO: 422575 - DNA, 27 bp, Artificial Sequence
  Description of Artificial Sequence: Synthetic oligonucleotide
gtggaggggggtcatagttctccctga

SEQ ID NO: 422576 - DNA, 27 bp, Artificial Sequence
  Description of Artificial Sequence: Synthetic oligonucleotide
tggaggggggtcatagttctccctgag

SEQ ID NO: 422577 - DNA, 27 bp, Artificial Sequence
  Description of Artificial Sequence: Synthetic oligonucleotide
ggaggggggtcatagttctccctgagt

SEQ ID NO: 422578 - DNA, 27 bp, Artificial Sequence
  Description of Artificial Sequence: Synthetic oligonucleotide
gaggggggtcatagttctccctgagtg

SEQ ID NO: 422579 - DNA, 28 bp, Artificial Sequence
  Description of Artificial Sequence: Synthetic oligonucleotide
aggggggtcatagttctccctgagtgag

SEQ ID NO: 422580 - DNA, 27 bp, Artificial Sequence
  Description of Artificial Sequence: Synthetic oligonucleotide
ggggggtcatagttctccctgagtgag

SEQ ID NO: 422581 - DNA, 28 bp, Artificial Sequence
  Description of Artificial Sequence: Synthetic oligonucleotide
gggggtcatagttctccctgagtgagac

SEQ ID NO: 422582 - DNA, 30 bp, Artificial Sequence
  Description of Artificial Sequence: Synthetic oligonucleotide
ggggtcatagttctccctgagtgagacttg

SEQ ID NO: 422583 - DNA, 30 bp, Artificial Sequence
  Description of Artificial Sequence: Synthetic oligonucleotide
gggtcatagttctccctgagtgagacttgc

SEQ ID NO: 422584 - DNA, 30 bp, Artificial Sequence
  Description of Artificial Sequence: Synthetic oligonucleotide
ggtcatagttctccctgagtgagacttgcc

SEQ ID NO: 422585 - DNA, 31 bp, Artificial Sequence
  Description of Artificial Sequence: Synthetic oligonucleotide
gtcatagttctccctgagtgagacttgcctg

SEQ ID NO: 422586 - DNA, 31 bp, Artificial Sequence
  Description of Artificial Sequence: Synthetic oligonucleotide
atagttctccctgagtgagacttgcctgctc

SEQ ID NO: 422587 - DNA, 30 bp, Artificial Sequence
  Description of Artificial Sequence: Synthetic oligonucleotide
tagttctccctgagtgagacttgcctgctc

SEQ ID NO: 422588 - DNA, 29 bp, Artificial Sequence
  Description of Artificial Sequence: Synthetic oligonucleotide
agttctccctgagtgagacttgcctgctc

SEQ ID NO: 422589 - DNA, 28 bp, Artificial Sequence
  Description of Artificial Sequence: Synthetic oligonucleotide
gttctccctgagtgagacttgcctgctc

SEQ ID NO: 422590 - DNA, 28 bp, Artificial Sequence
  Description of Artificial Sequence: Synthetic oligonucleotide
ttctccctgagtgagacttgcctgctcc

SEQ ID NO: 422591 - DNA, 27 bp, Artificial Sequence
  Description of Artificial Sequence: Synthetic oligonucleotide
tctccctgagtgagacttgcctgctcc

SEQ ID NO: 422592 - DNA, 27 bp, Artificial Sequence
  Description of Artificial Sequence: Synthetic oligonucleotide
ctccctgagtgagacttgcctgctcct

SEQ ID NO: 422593 - DNA, 27 bp, Artificial Sequence
  Description of Artificial Sequence: Synthetic oligonucleotide
tccctgagtgagacttgcctgctcctc

SEQ ID NO: 422594 - DNA, 27 bp, Artificial Sequence
  Description of Artificial Sequence: Synthetic oligonucleotide
ccctgagtgagacttgcctgctcctct

SEQ ID NO: 422595 - DNA, 27 bp, Artificial Sequence
  Description of Artificial Sequence: Synthetic oligonucleotide
cctgagtgagacttgcctgctcctctg

SEQ ID NO: 422596 - DNA, 27 bp, Artificial Sequence
  Description of Artificial Sequence: Synthetic oligonucleotide
ctgagtgagacttgcctgctcctctgg

SEQ ID NO: 422597 - DNA, 27 bp, Artificial Sequence
  Description of Artificial Sequence: Synthetic oligonucleotide
tgagtgagacttgcctgctcctctggc

SEQ ID NO: 422598 - DNA, 26 bp, Artificial Sequence
  Description of Artificial Sequence: Synthetic oligonucleotide
gagtgagacttgcctgctcctctggc

SEQ ID NO: 422599 - DNA, 26 bp, Artificial Sequence
  Description of Artificial Sequence: Synthetic oligonucleotide
agtgagacttgcctgctcctctggcc

SEQ ID NO: 422600 - DNA, 25 bp, Artificial Sequence
  Description of Artificial Sequence: Synthetic oligonucleotide
gtgagacttgcctgctcctctggcc

SEQ ID NO: 422601 - DNA, 25 bp, Artificial Sequence
  Description of Artificial Sequence: Synthetic oligonucleotide
tgagacttgcctgctcctctggccc

SEQ ID NO: 422602 - DNA, 24 bp, Artificial Sequence
  Description of Artificial Sequence: Synthetic oligonucleotide
gagacttgcctgctcctctggccc

SEQ ID NO: 422603 - DNA, 25 bp, Artificial Sequence
  Description of Artificial Sequence: Synthetic oligonucleotide
agacttgcctgctcctctggcccct

SEQ ID NO: 422604 - DNA, 24 bp, Artificial Sequence
  Description of Artificial Sequence: Synthetic oligonucleotide
gacttgcctgctcctctggcccct

SEQ ID NO: 422605 - DNA, 24 bp, Artificial Sequence
  Description of Artificial Sequence: Synthetic oligonucleotide
acttgcctgctcctctggcccctg

SEQ ID NO: 422606 - DNA, 23 bp, Artificial Sequence
  Description of Artificial Sequence: Synthetic oligonucleotide
cttgcctgctcctctggcccctg

SEQ ID NO: 422607 - DNA, 24 bp, Artificial Sequence
  Description of Artificial Sequence: Synthetic oligonucleotide
ttgcctgctcctctggcccctggt

SEQ ID NO: 422608 - DNA, 23 bp, Artificial Sequence
  Description of Artificial Sequence: Synthetic oligonucleotide
tgcctgctcctctggcccctggt

SEQ ID NO: 422609 - DNA, 22 bp, Artificial Sequence
  Description of Artificial Sequence: Synthetic oligonucleotide
gcctgctcctctggcccctggt

SEQ ID NO: 422610 - DNA, 25 bp, Artificial Sequence
  Description of Artificial Sequence: Synthetic oligonucleotide
ctctggcccctggtcctgtcctctt

SEQ ID NO: 422611 - DNA, 26 bp, Artificial Sequence
  Description of Artificial Sequence: Synthetic oligonucleotide
tctggcccctggtcctgtcctcttct

SEQ ID NO: 422612 - DNA, 28 bp, Artificial Sequence
  Description of Artificial Sequence: Synthetic oligonucleotide
agcacagagctggctcacaatagctccc

SEQ ID NO: 422613 - DNA, 27 bp, Artificial Sequence
  Description of Artificial Sequence: Synthetic oligonucleotide
gcacagagctggctcacaatagctccc

SEQ ID NO: 422614 - DNA, 27 bp, Artificial Sequence
  Description of Artificial Sequence: Synthetic oligonucleotide
cacagagctggctcacaatagctcccc

SEQ ID NO: 422615 - DNA, 34 bp, Artificial Sequence
  Description of Artificial Sequence: Synthetic oligonucleotide
acagagctggctcacaatagctccccaattaaag

SEQ ID NO: 422616 - DNA, 33 bp, Artificial Sequence
  Description of Artificial Sequence: Synthetic oligonucleotide
cagagctggctcacaatagctccccaattaaag

SEQ ID NO: 422617 - DNA, 34 bp, Artificial Sequence
  Description of Artificial Sequence: Synthetic oligonucleotide
agagctggctcacaatagctccccaattaaagtg

SEQ ID NO: 422618 - DNA, 33 bp, Artificial Sequence
  Description of Artificial Sequence: Synthetic oligonucleotide
gagctggctcacaatagctccccaattaaagtg

SEQ ID NO: 422619 - DNA, 38 bp, Artificial Sequence
  Description of Artificial Sequence: Synthetic oligonucleotide
agctggctcacaatagctccccaattaaagtgttttac

SEQ ID NO: 422620 - DNA, 37 bp, Artificial Sequence
  Description of Artificial Sequence: Synthetic oligonucleotide
gctggctcacaatagctccccaattaaagtgttttac

SEQ ID NO: 422621 - DNA, 39 bp, Artificial Sequence
  Description of Artificial Sequence: Synthetic oligonucleotide
ctggctcacaatagctccccaattaaagtgttttacatg

SEQ ID NO: 422622 - DNA, 39 bp, Artificial Sequence
  Description of Artificial Sequence: Synthetic oligonucleotide
tggctcacaatagctccccaattaaagtgttttacatgc

SEQ ID NO: 422623 - DNA, 38 bp, Artificial Sequence
  Description of Artificial Sequence: Synthetic oligonucleotide
ggctcacaatagctccccaattaaagtgttttacatgc

SEQ ID NO: 422624 - DNA, 40 bp, Artificial Sequence
  Description of Artificial Sequence: Synthetic oligonucleotide
gctcacaatagctccccaattaaagtgttttacatgcaac

SEQ ID NO: 422625 - DNA, 41 bp, Artificial Sequence
  Description of Artificial Sequence: Synthetic oligonucleotide
ctcacaatagctccccaattaaagtgttttacatgcaactg

SEQ ID NO: 422626 - DNA, 26 bp, Artificial Sequence
  Description of Artificial Sequence: Synthetic oligonucleotide
cggggccaggtggacaattactgcag

SEQ ID NO: 422627 - DNA, 26 bp, Artificial Sequence
  Description of Artificial Sequence: Synthetic oligonucleotide
ggggccaggtggacaattactgcagg

SEQ ID NO: 422628 - DNA, 27 bp, Artificial Sequence
  Description of Artificial Sequence: Synthetic oligonucleotide
gggccaggtggacaattactgcaggca

SEQ ID NO: 422629 - DNA, 27 bp, Artificial Sequence
  Description of Artificial Sequence: Synthetic oligonucleotide
ggccaggtggacaattactgcaggcac

SEQ ID NO: 422630 - DNA, 29 bp, Artificial Sequence
  Description of Artificial Sequence: Synthetic oligonucleotide
gccaggtggacaattactgcaggcacaac

SEQ ID NO: 422631 - DNA, 31 bp, Artificial Sequence; identical to SEQ ID NO: 74154
  Description of Artificial Sequence: Synthetic oligonucleotide

SEQ ID NO: 422632 - DNA, 31 bp, Artificial Sequence; identical to SEQ ID NO: 74155
  Description of Artificial Sequence: Synthetic oligonucleotide

SEQ ID NO: 422633 - DNA, 31 bp, Artificial Sequence; identical to SEQ ID NO: 74156
  Description of Artificial Sequence: Synthetic oligonucleotide

SEQ ID NO: 422634 - DNA, 30 bp, Artificial Sequence; identical to SEQ ID NO: 74157
  Description of Artificial Sequence: Synthetic oligonucleotide

SEQ ID NO: 422635 - DNA, 30 bp, Artificial Sequence; identical to SEQ ID NO: 74158
  Description of Artificial Sequence: Synthetic oligonucleotide

SEQ ID NO: 422636 - DNA, 30 bp, Artificial Sequence; identical to SEQ ID NO: 74159
  Description of Artificial Sequence: Synthetic oligonucleotide

SEQ ID NO: 422637 - DNA, 29 bp, Artificial Sequence
  Description of Artificial Sequence: Synthetic oligonucleotide
ggacaattactgcaggcacaactacgggg

SEQ ID NO: 422638 - DNA, 31 bp, Artificial Sequence; identical to SEQ ID NO: 74161
  Description of Artificial Sequence: Synthetic oligonucleotide

SEQ ID NO: 422639 - DNA, 31 bp, Artificial Sequence; identical to SEQ ID NO: 74162
  Description of Artificial Sequence: Synthetic oligonucleotide

SEQ ID NO: 422640 - DNA, 30 bp, Artificial Sequence; identical to SEQ ID NO: 74163
  Description of Artificial Sequence: Synthetic oligonucleotide

SEQ ID NO: 422641 - DNA, 31 bp, Artificial Sequence; identical to SEQ ID NO: 74164
  Description of Artificial Sequence: Synthetic oligonucleotide

SEQ ID NO: 422642 - DNA, 30 bp, Artificial Sequence; identical to SEQ ID NO: 74165
  Description of Artificial Sequence: Synthetic oligonucleotide

SEQ ID NO: 422643 - DNA, 29 bp, Artificial Sequence
  Description of Artificial Sequence: Synthetic oligonucleotide
ttactgcaggcacaactacggggttggtg

SEQ ID NO: 422644 - DNA, 28 bp, Artificial Sequence
  Description of Artificial Sequence: Synthetic oligonucleotide
tactgcaggcacaactacggggttggtg

SEQ ID NO: 422645 - DNA, 27 bp, Artificial Sequence
  Description of Artificial Sequence: Synthetic oligonucleotide
actgcaggcacaactacggggttggtg

SEQ ID NO: 422646 - DNA, 27 bp, Artificial Sequence
  Description of Artificial Sequence: Synthetic oligonucleotide
ctgcaggcacaactacggggttggtga

SEQ ID NO: 422647 - DNA, 27 bp, Artificial Sequence
  Description of Artificial Sequence: Synthetic oligonucleotide
tgcaggcacaactacggggttggtgag

SEQ ID NO: 422648 - DNA, 27 bp, Artificial Sequence
  Description of Artificial Sequence: Synthetic oligonucleotide
gcaggcacaactacggggttggtgaga

SEQ ID NO: 422649 - DNA, 27 bp, Artificial Sequence
  Description of Artificial Sequence: Synthetic oligonucleotide
caggcacaactacggggttggtgagag

SEQ ID NO: 422650 - DNA, 27 bp, Artificial Sequence
  Description of Artificial Sequence: Synthetic oligonucleotide
aggcacaactacggggttggtgagagc

SEQ ID NO: 422651 - DNA, 27 bp, Artificial Sequence
  Description of Artificial Sequence: Synthetic oligonucleotide
ggcacaactacggggttggtgagagct

SEQ ID NO: 422652 - DNA, 28 bp, Artificial Sequence
  Description of Artificial Sequence: Synthetic oligonucleotide
gcacaactacggggttggtgagagcttc

SEQ ID NO: 422653 - DNA, 23 bp, Artificial Sequence
  Description of Artificial Sequence: Synthetic oligonucleotide
cgcgcttcgacagcgacgtgggt

SEQ ID NO: 422654 - DNA, 24 bp, Artificial Sequence
  Description of Artificial Sequence: Synthetic oligonucleotide
gcgcttcgacagcgacgtgggtga

SEQ ID NO: 422655 - DNA, 26 bp, Artificial Sequence
  Description of Artificial Sequence: Synthetic oligonucleotide
cgcttcgacagcgacgtgggtgagta

SEQ ID NO: 422656 - DNA, 26 bp, Artificial Sequence
  Description of Artificial Sequence: Synthetic oligonucleotide
gcttcgacagcgacgtgggtgagtac

SEQ ID NO: 422657 - DNA, 26 bp, Artificial Sequence
  Description of Artificial Sequence: Synthetic oligonucleotide
cttcgacagcgacgtgggtgagtacc

SEQ ID NO: 422658 - DNA, 26 bp, Artificial Sequence
  Description of Artificial Sequence: Synthetic oligonucleotide
ttcgacagcgacgtgggtgagtaccg

SEQ ID NO: 422659 - DNA, 25 bp, Artificial Sequence
  Description of Artificial Sequence: Synthetic oligonucleotide
tcgacagcgacgtgggtgagtaccg

SEQ ID NO: 422660 - DNA, 24 bp, Artificial Sequence
  Description of Artificial Sequence: Synthetic oligonucleotide
cgacagcgacgtgggtgagtaccg

SEQ ID NO: 422661 - DNA, 24 bp, Artificial Sequence
  Description of Artificial Sequence: Synthetic oligonucleotide
gacagcgacgtgggtgagtaccgg

SEQ ID NO: 422662 - DNA, 24 bp, Artificial Sequence
  Description of Artificial Sequence: Synthetic oligonucleotide
acagcgacgtgggtgagtaccggg

SEQ ID NO: 422663 - DNA, 23 bp, Artificial Sequence
  Description of Artificial Sequence: Synthetic oligonucleotide
cagcgacgtgggtgagtaccggg

SEQ ID NO: 422664 - DNA, 23 bp, Artificial Sequence
  Description of Artificial Sequence: Synthetic oligonucleotide
agcgacgtgggtgagtaccgggc

SEQ ID NO: 422665 - DNA, 22 bp, Artificial Sequence
  Description of Artificial Sequence: Synthetic oligonucleotide
gcgacgtgggtgagtaccgggc

SEQ ID NO: 422666 - DNA, 22 bp, Artificial Sequence
  Description of Artificial Sequence: Synthetic oligonucleotide
cgacgtgggtgagtaccgggcg

SEQ ID NO: 422667 - DNA, 23 bp, Artificial Sequence
  Description of Artificial Sequence: Synthetic oligonucleotide
gacgtgggtgagtaccgggcggt

SEQ ID NO: 422668 - DNA, 24 bp, Artificial Sequence
  Description of Artificial Sequence: Synthetic oligonucleotide
acgtgggtgagtaccgggcggtga

SEQ ID NO: 422669 - DNA, 23 bp, Artificial Sequence
  Description of Artificial Sequence: Synthetic oligonucleotide
cgtgggtgagtaccgggcggtga

SEQ ID NO: 422670 - DNA, 23 bp, Artificial Sequence
  Description of Artificial Sequence: Synthetic oligonucleotide
gtgggtgagtaccgggcggtgag

SEQ ID NO: 422671 - DNA, 23 bp, Artificial Sequence
  Description of Artificial Sequence: Synthetic oligonucleotide
tgggtgagtaccgggcggtgagg

SEQ ID NO: 422672 - DNA, 22 bp, Artificial Sequence
  Description of Artificial Sequence: Synthetic oligonucleotide
gggtgagtaccgggcggtgagg

SEQ ID NO: 422673 - DNA, 23 bp, Artificial Sequence
  Description of Artificial Sequence: Synthetic oligonucleotide
ggtgagtaccgggcggtgaggga

SEQ ID NO: 422674 - DNA, 23 bp, Artificial Sequence
  Description of Artificial Sequence: Synthetic oligonucleotide
gtgagtaccgggcggtgagggag

SEQ ID NO: 422675 - DNA, 24 bp, Artificial Sequence
  Description of Artificial Sequence: Synthetic oligonucleotide
tgagtaccgggcggtgagggagct

SEQ ID NO: 422676 - DNA, 31 bp, Artificial Sequence; identical to SEQ ID NO: 74199
  Description of Artificial Sequence: Synthetic oligonucleotide

SEQ ID NO: 422677 - DNA, 30 bp, Artificial Sequence; identical to SEQ ID NO: 74200
  Description of Artificial Sequence: Synthetic oligonucleotide

SEQ ID NO: 422678 - DNA, 30 bp, Artificial Sequence; identical to SEQ ID NO: 74201
  Description of Artificial Sequence: Synthetic oligonucleotide

SEQ ID NO: 422679 - DNA, 30 bp, Artificial Sequence; identical to SEQ ID NO: 74202
  Description of Artificial Sequence: Synthetic oligonucleotide

SEQ ID NO: 422680 - DNA, 29 bp, Artificial Sequence
  Description of Artificial Sequence: Synthetic oligonucleotide
gagacacttccataaccaggaggagtccg

SEQ ID NO: 422681 - DNA, 30 bp, Artificial Sequence; identical to SEQ ID NO: 74204
  Description of Artificial Sequence: Synthetic oligonucleotide

SEQ ID NO: 422682 - DNA, 29 bp, Artificial Sequence
  Description of Artificial Sequence: Synthetic oligonucleotide
gacacttccataaccaggaggagtccgtg

SEQ ID NO: 422683 - DNA, 29 bp, Artificial Sequence
  Description of Artificial Sequence: Synthetic oligonucleotide
acacttccataaccaggaggagtccgtgc

SEQ ID NO: 422684 - DNA, 28 bp, Artificial Sequence
  Description of Artificial Sequence: Synthetic oligonucleotide
cacttccataaccaggaggagtccgtgc

SEQ ID NO: 422685 - DNA, 33 bp, Artificial Sequence; identical to SEQ ID NO: 74208
  Description of Artificial Sequence: Synthetic oligonucleotide

SEQ ID NO: 422686 - DNA, 33 bp, Artificial Sequence; identical to SEQ ID NO: 74209
  Description of Artificial Sequence: Synthetic oligonucleotide

SEQ ID NO: 422687 - DNA, 32 bp, Artificial Sequence; identical to SEQ ID NO: 74210
  Description of Artificial Sequence: Synthetic oligonucleotide

SEQ ID NO: 422688 - DNA, 32 bp, Artificial Sequence; identical to SEQ ID NO: 74211
  Description of Artificial Sequence: Synthetic oligonucleotide

SEQ ID NO: 422689 - DNA, 32 bp, Artificial Sequence; identical to SEQ ID NO: 74212
  Description of Artificial Sequence: Synthetic oligonucleotide

SEQ ID NO: 422690 - DNA, 31 bp, Artificial Sequence; identical to SEQ ID NO: 74213
  Description of Artificial Sequence: Synthetic oligonucleotide

SEQ ID NO: 422691 - DNA, 32 bp, Artificial Sequence; identical to SEQ ID NO: 74214
  Description of Artificial Sequence: Synthetic oligonucleotide

SEQ ID NO: 422692 - DNA, 31 bp, Artificial Sequence; identical to SEQ ID NO: 74215
  Description of Artificial Sequence: Synthetic oligonucleotide

SEQ ID NO: 422693 - DNA, 31 bp, Artificial Sequence; identical to SEQ ID NO: 74216
  Description of Artificial Sequence: Synthetic oligonucleotide

SEQ ID NO: 422694 - DNA, 31 bp, Artificial Sequence; identical to SEQ ID NO: 74217
  Description of Artificial Sequence: Synthetic oligonucleotide

SEQ ID NO: 422695 - DNA, 30 bp, Artificial Sequence; identical to SEQ ID NO: 74218
  Description of Artificial Sequence: Synthetic oligonucleotide

SEQ ID NO: 422696 - DNA, 30 bp, Artificial Sequence; identical to SEQ ID NO: 74219
  Description of Artificial Sequence: Synthetic oligonucleotide

SEQ ID NO: 422697 - DNA, 29 bp, Artificial Sequence
  Description of Artificial Sequence: Synthetic oligonucleotide
gacacttccataaccaggaggagaacgcg

SEQ ID NO: 422698 - DNA, 29 bp, Artificial Sequence
  Description of Artificial Sequence: Synthetic oligonucleotide
acacttccataaccaggaggagaacgcgc

SEQ ID NO: 422699 - DNA, 28 bp, Artificial Sequence
  Description of Artificial Sequence: Synthetic oligonucleotide
cacttccataaccaggaggagaacgcgc

SEQ ID NO: 422700 - DNA, 25 bp, Artificial Sequence
  Description of Artificial Sequence: Synthetic oligonucleotide
acatcctggagcagaagcggggcca

SEQ ID NO: 422701 - DNA, 24 bp, Artificial Sequence
  Description of Artificial Sequence: Synthetic oligonucleotide
catcctggagcagaagcggggcca

SEQ ID NO: 422702 - DNA, 24 bp, Artificial Sequence
  Description of Artificial Sequence: Synthetic oligonucleotide
atcctggagcagaagcggggccag

SEQ ID NO: 422703 - DNA, 33 bp, Artificial Sequence; identical to SEQ ID NO: 74235
  Description of Artificial Sequence: Synthetic oligonucleotide

SEQ ID NO: 422704 - DNA, 37 bp, Artificial Sequence; identical to SEQ ID NO: 74236
  Description of Artificial Sequence: Synthetic oligonucleotide

SEQ ID NO: 422705 - DNA, 36 bp, Artificial Sequence; identical to SEQ ID NO: 74237
  Description of Artificial Sequence: Synthetic oligonucleotide

SEQ ID NO: 422706 - DNA, 38 bp, Artificial Sequence; identical to SEQ ID NO: 74238
  Description of Artificial Sequence: Synthetic oligonucleotide

SEQ ID NO: 422707 - DNA, 41 bp, Artificial Sequence; identical to SEQ ID NO: 74239
  Description of Artificial Sequence: Synthetic oligonucleotide

SEQ ID NO: 422708 - DNA, 40 bp, Artificial Sequence; identical to SEQ ID NO: 74240
  Description of Artificial Sequence: Synthetic oligonucleotide

SEQ ID NO: 422709 - DNA, 39 bp, Artificial Sequence; identical to SEQ ID NO: 74241
  Description of Artificial Sequence: Synthetic oligonucleotide

SEQ ID NO: 422710 - DNA, 38 bp, Artificial Sequence; identical to SEQ ID NO: 74242
  Description of Artificial Sequence: Synthetic oligonucleotide

SEQ ID NO: 422711 - DNA, 38 bp, Artificial Sequence; identical to SEQ ID NO: 74243
  Description of Artificial Sequence: Synthetic oligonucleotide

SEQ ID NO: 422712 - DNA, 37 bp, Artificial Sequence; identical to SEQ ID NO: 74244
  Description of Artificial Sequence: Synthetic oligonucleotide

SEQ ID NO: 422713 - DNA, 36 bp, Artificial Sequence; identical to SEQ ID NO: 74245
  Description of Artificial Sequence: Synthetic oligonucleotide

SEQ ID NO: 422714 - DNA, 36 bp, Artificial Sequence; identical to SEQ ID NO: 74246
  Description of Artificial Sequence: Synthetic oligonucleotide

SEQ ID NO: 422715 - DNA, 24 bp, Artificial Sequence
  Description of Artificial Sequence: Synthetic oligonucleotide
ttcaatgggacggagcgggtgcgg

SEQ ID NO: 422716 - DNA, 23 bp, Artificial Sequence
  Description of Artificial Sequence: Synthetic oligonucleotide
tcaatgggacggagcgggtgcgg

SEQ ID NO: 422717 - DNA, 22 bp, Artificial Sequence
  Description of Artificial Sequence: Synthetic oligonucleotide
caatgggacggagcgggtgcgg

SEQ ID NO: 422718 - DNA, 23 bp, Artificial Sequence
  Description of Artificial Sequence: Synthetic oligonucleotide
aatgggacggagcgggtgcggct

SEQ ID NO: 422719 - DNA, 22 bp, Artificial Sequence
  Description of Artificial Sequence: Synthetic oligonucleotide
atgggacggagcgggtgcggct

SEQ ID NO: 422720 - DNA, 21 bp, Artificial Sequence
  Description of Artificial Sequence: Synthetic oligonucleotide
tgggacggagcgggtgcggct

SEQ ID NO: 422721 - DNA, 20 bp, Artificial Sequence
  Description of Artificial Sequence: Synthetic oligonucleotide
gggacggagcgggtgcggct

SEQ ID NO: 422722 - DNA, 20 bp, Artificial Sequence
  Description of Artificial Sequence: Synthetic oligonucleotide
ggacggagcgggtgcggctc

SEQ ID NO: 422723 - DNA, 21 bp, Artificial Sequence
  Description of Artificial Sequence: Synthetic oligonucleotide
gacggagcgggtgcggctcct

SEQ ID NO: 422724 - DNA, 21 bp, Artificial Sequence
  Description of Artificial Sequence: Synthetic oligonucleotide
acggagcgggtgcggctcctg

SEQ ID NO: 422725 - DNA, 20 bp, Artificial Sequence
  Description of Artificial Sequence: Synthetic oligonucleotide
cggagcgggtgcggctcctg

SEQ ID NO: 422726 - DNA, 21 bp, Artificial Sequence
  Description of Artificial Sequence: Synthetic oligonucleotide
ggagcgggtgcggctcctgga

SEQ ID NO: 422727 - DNA, 22 bp, Artificial Sequence
  Description of Artificial Sequence: Synthetic oligonucleotide
gagcgggtgcggctcctggaga

SEQ ID NO: 422728 - DNA, 23 bp, Artificial Sequence
  Description of Artificial Sequence: Synthetic oligonucleotide
agcgggtgcggctcctggagaga

SEQ ID NO: 422729 - DNA, 22 bp, Artificial Sequence
  Description of Artificial Sequence: Synthetic oligonucleotide
gcgggtgcggctcctggagaga

SEQ ID NO: 422730 - DNA, 23 bp, Artificial Sequence
  Description of Artificial Sequence: Synthetic oligonucleotide
cgggtgcggctcctggagagaca

SEQ ID NO: 422731 - DNA, 25 bp, Artificial Sequence
  Description of Artificial Sequence: Synthetic oligonucleotide
gggtgcggctcctggagagacactt

SEQ ID NO: 422732 - DNA, 25 bp, Artificial Sequence
  Description of Artificial Sequence: Synthetic oligonucleotide
ggtgcggctcctggagagacacttc

SEQ ID NO: 422733 - DNA, 27 bp, Artificial Sequence
  Description of Artificial Sequence: Synthetic oligonucleotide
gtgcggctcctggagagacacttccat

SEQ ID NO: 422734 - DNA, 29 bp, Artificial Sequence
  Description of Artificial Sequence: Synthetic oligonucleotide
tgcggctcctggagagacacttccataac

SEQ ID NO: 422735 - DNA, 28 bp, Artificial Sequence
  Description of Artificial Sequence: Synthetic oligonucleotide
gcggctcctggagagacacttccataac

SEQ ID NO: 422736 - DNA, 28 bp, Artificial Sequence
  Description of Artificial Sequence: Synthetic oligonucleotide
cggctcctggagagacacttccataacc

SEQ ID NO: 422737 - DNA, 29 bp, Artificial Sequence
  Description of Artificial Sequence: Synthetic oligonucleotide
ggctcctggagagacacttccataaccag

SEQ ID NO: 422738 - DNA, 29 bp, Artificial Sequence
  Description of Artificial Sequence: Synthetic oligonucleotide
gctcctggagagacacttccataaccagg

SEQ ID NO: 422739 - DNA, 30 bp, Artificial Sequence; identical to SEQ ID NO: 74271
  Description of Artificial Sequence: Synthetic oligonucleotide

SEQ ID NO: 422740 - DNA, 32 bp, Artificial Sequence; identical to SEQ ID NO: 74272
  Description of Artificial Sequence: Synthetic oligonucleotide

SEQ ID NO: 422741 - DNA, 33 bp, Artificial Sequence; identical to SEQ ID NO: 74273
  Description of Artificial Sequence: Synthetic oligonucleotide

SEQ ID NO: 422742 - DNA, 32 bp, Artificial Sequence; identical to SEQ ID NO: 74274
  Description of Artificial Sequence: Synthetic oligonucleotide

SEQ ID NO: 422743 - DNA, 33 bp, Artificial Sequence; identical to SEQ ID NO: 74275
  Description of Artificial Sequence: Synthetic oligonucleotide

SEQ ID NO: 422744 - DNA, 32 bp, Artificial Sequence; identical to SEQ ID NO: 74276
  Description of Artificial Sequence: Synthetic oligonucleotide

SEQ ID NO: 422745 - DNA, 31 bp, Artificial Sequence; identical to SEQ ID NO: 74277
  Description of Artificial Sequence: Synthetic oligonucleotide

SEQ ID NO: 422746 - DNA, 30 bp, Artificial Sequence; identical to SEQ ID NO: 74278
  Description of Artificial Sequence: Synthetic oligonucleotide

SEQ ID NO: 422747 - DNA, 29 bp, Artificial Sequence
  Description of Artificial Sequence: Synthetic oligonucleotide
actgcagacacaactacggggttgctgag

SEQ ID NO: 422748 - DNA, 28 bp, Artificial Sequence
  Description of Artificial Sequence: Synthetic oligonucleotide
ctgcagacacaactacggggttgctgag

SEQ ID NO: 422749 - DNA, 29 bp, Artificial Sequence
  Description of Artificial Sequence: Synthetic oligonucleotide
tgcagacacaactacggggttgctgagag

SEQ ID NO: 422750 - DNA, 28 bp, Artificial Sequence
  Description of Artificial Sequence: Synthetic oligonucleotide
gcagacacaactacggggttgctgagag

SEQ ID NO: 422751 - DNA, 28 bp, Artificial Sequence
  Description of Artificial Sequence: Synthetic oligonucleotide
cagacacaactacggggttgctgagagc

SEQ ID NO: 422752 - DNA, 30 bp, Artificial Sequence; identical to SEQ ID NO: 74284
  Description of Artificial Sequence: Synthetic oligonucleotide

SEQ ID NO: 422753 - DNA, 29 bp, Artificial Sequence
  Description of Artificial Sequence: Synthetic oligonucleotide
gacacaactacggggttgctgagagcttc

SEQ ID NO: 422754 - DNA, 30 bp, Artificial Sequence; identical to SEQ ID NO: 74286
  Description of Artificial Sequence: Synthetic oligonucleotide

SEQ ID NO: 422755 - DNA, 29 bp, Artificial Sequence
  Description of Artificial Sequence: Synthetic oligonucleotide
cacaactacggggttgctgagagcttcac

SEQ ID NO: 422756 - DNA, 30 bp, Artificial Sequence; identical to SEQ ID NO: 74288
  Description of Artificial Sequence: Synthetic oligonucleotide

SEQ ID NO: 422757 - DNA, 29 bp, Artificial Sequence
  Description of Artificial Sequence: Synthetic oligonucleotide
caactacggggttgctgagagcttcacag

SEQ ID NO: 422758 - DNA, 30 bp, Artificial Sequence; identical to SEQ ID NO: 74290
  Description of Artificial Sequence: Synthetic oligonucleotide

SEQ ID NO: 422759 - DNA, 29 bp, Artificial Sequence
  Description of Artificial Sequence: Synthetic oligonucleotide
actacggggttgctgagagcttcacagtg

SEQ ID NO: 422760 - DNA, 28 bp, Artificial Sequence
  Description of Artificial Sequence: Synthetic oligonucleotide
ctacggggttgctgagagcttcacagtg

SEQ ID NO: 422761 - DNA, 28 bp, Artificial Sequence
  Description of Artificial Sequence: Synthetic oligonucleotide
tacggggttgctgagagcttcacagtgc

SEQ ID NO: 422762 - DNA, 27 bp, Artificial Sequence
  Description of Artificial Sequence: Synthetic oligonucleotide
acggggttgctgagagcttcacagtgc

SEQ ID NO: 422763 - DNA, 27 bp, Artificial Sequence
  Description of Artificial Sequence: Synthetic oligonucleotide
cggggttgctgagagcttcacagtgca

SEQ ID NO: 422764 - DNA, 27 bp, Artificial Sequence
  Description of Artificial Sequence: Synthetic oligonucleotide
ggggttgctgagagcttcacagtgcag

SEQ ID NO: 422765 - DNA, 27 bp, Artificial Sequence
  Description of Artificial Sequence: Synthetic oligonucleotide
gggttgctgagagcttcacagtgcagc

SEQ ID NO: 422766 - DNA, 27 bp, Artificial Sequence
  Description of Artificial Sequence: Synthetic oligonucleotide
ggttgctgagagcttcacagtgcagcg

SEQ ID NO: 422767 - DNA, 27 bp, Artificial Sequence
  Description of Artificial Sequence: Synthetic oligonucleotide
gttgctgagagcttcacagtgcagcgg

SEQ ID NO: 422768 - DNA, 27 bp, Artificial Sequence
  Description of Artificial Sequence: Synthetic oligonucleotide
ttgctgagagcttcacagtgcagcggc

SEQ ID NO: 422769 - DNA, 26 bp, Artificial Sequence
  Description of Artificial Sequence: Synthetic oligonucleotide
tgctgagagcttcacagtgcagcggc

SEQ ID NO: 422770 - DNA, 25 bp, Artificial Sequence
  Description of Artificial Sequence: Synthetic oligonucleotide
gctgagagcttcacagtgcagcggc

SEQ ID NO: 422771 - DNA, 26 bp, Artificial Sequence
  Description of Artificial Sequence: Synthetic oligonucleotide
ctgagagcttcacagtgcagcggcga

SEQ ID NO: 422772 - DNA, 32 bp, Artificial Sequence; identical to SEQ ID NO: 74304
  Description of Artificial Sequence: Synthetic oligonucleotide

SEQ ID NO: 422773 - DNA, 31 bp, Artificial Sequence; identical to SEQ ID NO: 74305
  Description of Artificial Sequence: Synthetic oligonucleotide

SEQ ID NO: 422774 - DNA, 31 bp, Artificial Sequence; identical to SEQ ID NO: 74306
  Description of Artificial Sequence: Synthetic oligonucleotide

SEQ ID NO: 422775 - DNA, 30 bp, Artificial Sequence; identical to SEQ ID NO: 74307
  Description of Artificial Sequence: Synthetic oligonucleotide

SEQ ID NO: 422776 - DNA, 30 bp, Artificial Sequence; identical to SEQ ID NO: 74308
  Description of Artificial Sequence: Synthetic oligonucleotide

SEQ ID NO: 422777 - DNA, 29 bp, Artificial Sequence
  Description of Artificial Sequence: Synthetic oligonucleotide
cacttccataaccaggaggagaacgtgcg

SEQ ID NO: 422778 - DNA, 21 bp, Artificial Sequence
  Description of Artificial Sequence: Synthetic oligonucleotide
ggcggtgagggagctggggct

SEQ ID NO: 422779 - DNA, 21 bp, Artificial Sequence
  Description of Artificial Sequence: Synthetic oligonucleotide
gcggtgagggagctggggctg

SEQ ID NO: 422780 - DNA, 21 bp, Artificial Sequence
  Description of Artificial Sequence: Synthetic oligonucleotide
cggtgagggagctggggctgc

SEQ ID NO: 422781 - DNA, 22 bp, Artificial Sequence
  Description of Artificial Sequence: Synthetic oligonucleotide
ggtgagggagctggggctgcct

SEQ ID NO: 422782 - DNA, 24 bp, Artificial Sequence
  Description of Artificial Sequence: Synthetic oligonucleotide
gtgagggagctggggctgcctgat

SEQ ID NO: 422783 - DNA, 24 bp, Artificial Sequence
  Description of Artificial Sequence: Synthetic oligonucleotide
tgagggagctggggctgcctgatg

SEQ ID NO: 422784 - DNA, 23 bp, Artificial Sequence
  Description of Artificial Sequence: Synthetic oligonucleotide
gagggagctggggctgcctgatg

SEQ ID NO: 422785 - DNA, 23 bp, Artificial Sequence
  Description of Artificial Sequence: Synthetic oligonucleotide
agggagctggggctgcctgatgc

SEQ ID NO: 422786 - DNA, 22 bp, Artificial Sequence
  Description of Artificial Sequence: Synthetic oligonucleotide
gggagctggggctgcctgatgc

SEQ ID NO: 422787 - DNA, 22 bp, Artificial Sequence
  Description of Artificial Sequence: Synthetic oligonucleotide
ggagctggggctgcctgatgcc

SEQ ID NO: 422788 - DNA, 23 bp, Artificial Sequence
  Description of Artificial Sequence: Synthetic oligonucleotide
gagctggggctgcctgatgccga

SEQ ID NO: 422789 - DNA, 25 bp, Artificial Sequence
  Description of Artificial Sequence: Synthetic oligonucleotide
agctggggctgcctgatgccgagta

SEQ ID NO: 422790 - DNA, 24 bp, Artificial Sequence
  Description of Artificial Sequence: Synthetic oligonucleotide
gctggggctgcctgatgccgagta

SEQ ID NO: 422791 - DNA, 25 bp, Artificial Sequence
  Description of Artificial Sequence: Synthetic oligonucleotide
ctggggctgcctgatgccgagtact

SEQ ID NO: 422792 - DNA, 25 bp, Artificial Sequence
  Description of Artificial Sequence: Synthetic oligonucleotide
tggggctgcctgatgccgagtactg

SEQ ID NO: 422793 - DNA, 24 bp, Artificial Sequence
  Description of Artificial Sequence: Synthetic oligonucleotide
ggggctgcctgatgccgagtactg

SEQ ID NO: 422794 - DNA, 26 bp, Artificial Sequence
  Description of Artificial Sequence: Synthetic oligonucleotide
gggctgcctgatgccgagtactggaa

SEQ ID NO: 422795 - DNA, 27 bp, Artificial Sequence
  Description of Artificial Sequence: Synthetic oligonucleotide
ggctgcctgatgccgagtactggaaca

SEQ ID NO: 422796 - DNA, 27 bp, Artificial Sequence
  Description of Artificial Sequence: Synthetic oligonucleotide
gctgcctgatgccgagtactggaacag

SEQ ID NO: 422797 - DNA, 27 bp, Artificial Sequence
  Description of Artificial Sequence: Synthetic oligonucleotide
ctgcctgatgccgagtactggaacagc

SEQ ID NO: 422798 - DNA, 27 bp, Artificial Sequence
  Description of Artificial Sequence: Synthetic oligonucleotide
tgcctgatgccgagtactggaacagcc

SEQ ID NO: 422799 - DNA, 22 bp, Artificial Sequence
  Description of Artificial Sequence: Synthetic oligonucleotide
acctcctggagcagaggcgggg

SEQ ID NO: 422800 - DNA, 21 bp, Artificial Sequence
  Description of Artificial Sequence: Synthetic oligonucleotide
cctcctggagcagaggcgggg

SEQ ID NO: 422801 - DNA, 21 bp, Artificial Sequence
  Description of Artificial Sequence: Synthetic oligonucleotide
ctcctggagcagaggcggggc

SEQ ID NO: 422802 - DNA, 22 bp, Artificial Sequence
  Description of Artificial Sequence: Synthetic oligonucleotide
tcctggagcagaggcggggcca

SEQ ID NO: 422803 - DNA, 21 bp, Artificial Sequence
  Description of Artificial Sequence: Synthetic oligonucleotide
cctggagcagaggcggggcca

SEQ ID NO: 422804 - DNA, 21 bp, Artificial Sequence
  Description of Artificial Sequence: Synthetic oligonucleotide
ctggagcagaggcggggccag

SEQ ID NO: 422805 - DNA, 22 bp, Artificial Sequence
  Description of Artificial Sequence: Synthetic oligonucleotide
tggagcagaggcggggccaggt

SEQ ID NO: 422806 - DNA, 21 bp, Artificial Sequence
  Description of Artificial Sequence: Synthetic oligonucleotide
ggagcagaggcggggccaggt

SEQ ID NO: 422807 - DNA, 21 bp, Artificial Sequence
  Description of Artificial Sequence: Synthetic oligonucleotide
gagcagaggcggggccaggtg

SEQ ID NO: 422808 - DNA, 22 bp, Artificial Sequence
  Description of Artificial Sequence: Synthetic oligonucleotide
agcagaggcggggccaggtgga

SEQ ID NO: 422809 - DNA, 21 bp, Artificial Sequence
  Description of Artificial Sequence: Synthetic oligonucleotide
gcagaggcggggccaggtgga

SEQ ID NO: 422810 - DNA, 26 bp, Artificial Sequence
  Description of Artificial Sequence: Synthetic oligonucleotide
cagaggcggggccaggtggacaatta

SEQ ID NO: 422811 - DNA, 27 bp, Artificial Sequence
  Description of Artificial Sequence: Synthetic oligonucleotide
agaggcggggccaggtggacaattact

SEQ ID NO: 422812 - DNA, 26 bp, Artificial Sequence
  Description of Artificial Sequence: Synthetic oligonucleotide
gaggcggggccaggtggacaattact

SEQ ID NO: 422813 - DNA, 29 bp, Artificial Sequence
  Description of Artificial Sequence: Synthetic oligonucleotide
ctcctggtctgctctgtgagtggtttctg

SEQ ID NO: 422814 - DNA, 30 bp, Artificial Sequence
  Description of Artificial Sequence: Synthetic oligonucleotide
tcctggtctgctctgtgagtggtttctgtc

SEQ ID NO: 422815 - DNA, 29 bp, Artificial Sequence
  Description of Artificial Sequence: Synthetic oligonucleotide
cctggtctgctctgtgagtggtttctgtc

SEQ ID NO: 422816 - DNA, 29 bp, Artificial Sequence
  Description of Artificial Sequence: Synthetic oligonucleotide
ctggtctgctctgtgagtggtttctgtcc

SEQ ID NO: 422817 - DNA, 30 bp, Artificial Sequence
  Description of Artificial Sequence: Synthetic oligonucleotide
tggtctgctctgtgagtggtttctgtccag

SEQ ID NO: 422818 - DNA, 29 bp, Artificial Sequence
  Description of Artificial Sequence: Synthetic oligonucleotide
ggtctgctctgtgagtggtttctgtccag

SEQ ID NO: 422819 - DNA, 29 bp, Artificial Sequence
  Description of Artificial Sequence: Synthetic oligonucleotide
gtctgctctgtgagtggtttctgtccagg

SEQ ID NO: 422820 - DNA, 29 bp, Artificial Sequence
  Description of Artificial Sequence: Synthetic oligonucleotide
tctgctctgtgagtggtttctgtccaggc

SEQ ID NO: 422821 - DNA, 28 bp, Artificial Sequence
  Description of Artificial Sequence: Synthetic oligonucleotide
ctgctctgtgagtggtttctgtccaggc

SEQ ID NO: 422822 - DNA, 29 bp, Artificial Sequence
  Description of Artificial Sequence: Synthetic oligonucleotide
tgctctgtgagtggtttctgtccaggcag

SEQ ID NO: 422823 - DNA, 28 bp, Artificial Sequence
  Description of Artificial Sequence: Synthetic oligonucleotide
gctctgtgagtggtttctgtccaggcag

SEQ ID NO: 422824 - DNA, 28 bp, Artificial Sequence
  Description of Artificial Sequence: Synthetic oligonucleotide
ctctgtgagtggtttctgtccaggcagc

SEQ ID NO: 422825 - DNA, 31 bp, Artificial Sequence
  Description of Artificial Sequence: Synthetic oligonucleotide
tctgtgagtggtttctgtccaggcagcattg

SEQ ID NO: 422826 - DNA, 30 bp, Artificial Sequence
  Description of Artificial Sequence: Synthetic oligonucleotide
ctgtgagtggtttctgtccaggcagcattg

SEQ ID NO: 422827 - DNA, 32 bp, Artificial Sequence
  Description of Artificial Sequence: Synthetic oligonucleotide
tgtgagtggtttctgtccaggcagcattgaag

SEQ ID NO: 422828 - DNA, 31 bp, Artificial Sequence
  Description of Artificial Sequence: Synthetic oligonucleotide
gtgagtggtttctgtccaggcagcattgaag

SEQ ID NO: 422829 - DNA, 32 bp, Artificial Sequence
  Description of Artificial Sequence: Synthetic oligonucleotide
tgagtggtttctgtccaggcagcattgaagtc

SEQ ID NO: 422830 - DNA, 31 bp, Artificial Sequence
  Description of Artificial Sequence: Synthetic oligonucleotide
gagtggtttctgtccaggcagcattgaagtc

SEQ ID NO: 422831 - DNA, 32 bp, Artificial Sequence
  Description of Artificial Sequence: Synthetic oligonucleotide
agtggtttctgtccaggcagcattgaagtcag

SEQ ID NO: 422832 - DNA, 31 bp, Artificial Sequence
  Description of Artificial Sequence: Synthetic oligonucleotide
gtggtttctgtccaggcagcattgaagtcag

SEQ ID NO: 422833 - DNA, 31 bp, Artificial Sequence
  Description of Artificial Sequence: Synthetic oligonucleotide
tggtttctgtccaggcagcattgaagtcagg

SEQ ID NO: 422834 - DNA, 30 bp, Artificial Sequence
  Description of Artificial Sequence: Synthetic oligonucleotide
ggtttctgtccaggcagcattgaagtcagg

SEQ ID NO: 422835 - DNA, 31 bp, Artificial Sequence
  Description of Artificial Sequence: Synthetic oligonucleotide
gtttctgtccaggcagcattgaagtcaggtg

SEQ ID NO: 422836 - DNA, 31 bp, Artificial Sequence
  Description of Artificial Sequence: Synthetic oligonucleotide
tttctgtccaggcagcattgaagtcaggtgg

SEQ ID NO: 422837 - DNA, 30 bp, Artificial Sequence
  Description of Artificial Sequence: Synthetic oligonucleotide
ttctgtccaggcagcattgaagtcaggtgg

SEQ ID NO: 422838 - DNA, 29 bp, Artificial Sequence
  Description of Artificial Sequence: Synthetic oligonucleotide
tctgtccaggcagcattgaagtcaggtgg

SEQ ID NO: 422839 - DNA, 28 bp, Artificial Sequence
  Description of Artificial Sequence: Synthetic oligonucleotide
ctgtccaggcagcattgaagtcaggtgg

SEQ ID NO: 422840 - DNA, 30 bp, Artificial Sequence
  Description of Artificial Sequence: Synthetic oligonucleotide
tgtccaggcagcattgaagtcaggtggttc

SEQ ID NO: 422841 - DNA, 29 bp, Artificial Sequence
  Description of Artificial Sequence: Synthetic oligonucleotide
gtccaggcagcattgaagtcaggtggttc

SEQ ID NO: 422842 - DNA, 27 bp, Artificial Sequence
  Description of Artificial Sequence: Synthetic oligonucleotide
gggtggtgtccacaggcctgatccata

SEQ ID NO: 422843 - DNA, 29 bp, Artificial Sequence
  Description of Artificial Sequence: Synthetic oligonucleotide
ggtggtgtccacaggcctgatccataatg

SEQ ID NO: 422844 - DNA, 29 bp, Artificial Sequence
  Description of Artificial Sequence: Synthetic oligonucleotide
gtggtgtccacaggcctgatccataatgg

SEQ ID NO: 422845 - DNA, 30 bp, Artificial Sequence; identical to SEQ ID NO: 74334
  Description of Artificial Sequence: Synthetic oligonucleotide

SEQ ID NO: 422846 - DNA, 29 bp, Artificial Sequence
  Description of Artificial Sequence: Synthetic oligonucleotide
ggtgtccacaggcctgatccataatggag

SEQ ID NO: 422847 - DNA, 30 bp, Artificial Sequence; identical to SEQ ID NO: 74336
  Description of Artificial Sequence: Synthetic oligonucleotide

SEQ ID NO: 422848 - DNA, 31 bp, Artificial Sequence; identical to SEQ ID NO: 74337
  Description of Artificial Sequence: Synthetic oligonucleotide

SEQ ID NO: 422849 - DNA, 30 bp, Artificial Sequence; identical to SEQ ID NO: 74338
  Description of Artificial Sequence: Synthetic oligonucleotide

SEQ ID NO: 422850 - DNA, 30 bp, Artificial Sequence; identical to SEQ ID NO: 74339
  Description of Artificial Sequence: Synthetic oligonucleotide

SEQ ID NO: 422851 - DNA, 29 bp, Artificial Sequence
  Description of Artificial Sequence: Synthetic oligonucleotide
ccacaggcctgatccataatggagactgg

SEQ ID NO: 422852 - DNA, 30 bp, Artificial Sequence; identical to SEQ ID NO: 74341
  Description of Artificial Sequence: Synthetic oligonucleotide

SEQ ID NO: 422853 - DNA, 30 bp, Artificial Sequence; identical to SEQ ID NO: 74342
  Description of Artificial Sequence: Synthetic oligonucleotide

SEQ ID NO: 422854 - DNA, 29 bp, Artificial Sequence
  Description of Artificial Sequence: Synthetic oligonucleotide
caggcctgatccataatggagactggacc

SEQ ID NO: 422855 - DNA, 31 bp, Artificial Sequence; identical to SEQ ID NO: 74344
  Description of Artificial Sequence: Synthetic oligonucleotide

SEQ ID NO: 422856 - DNA, 30 bp, Artificial Sequence; identical to SEQ ID NO: 74345
  Description of Artificial Sequence: Synthetic oligonucleotide

SEQ ID NO: 422857 - DNA, 30 bp, Artificial Sequence; identical to SEQ ID NO: 74346
  Description of Artificial Sequence: Synthetic oligonucleotide

SEQ ID NO: 422858 - DNA, 31 bp, Artificial Sequence; identical to SEQ ID NO: 74347
  Description of Artificial Sequence: Synthetic oligonucleotide

SEQ ID NO: 422859 - DNA, 32 bp, Artificial Sequence; identical to SEQ ID NO: 74348
  Description of Artificial Sequence: Synthetic oligonucleotide

SEQ ID NO: 422860 - DNA, 32 bp, Artificial Sequence; identical to SEQ ID NO: 74349
  Description of Artificial Sequence: Synthetic oligonucleotide

SEQ ID NO: 422861 - DNA, 31 bp, Artificial Sequence; identical to SEQ ID NO: 74350
  Description of Artificial Sequence: Synthetic oligonucleotide

SEQ ID NO: 422862 - DNA, 31 bp, Artificial Sequence; identical to SEQ ID NO: 74351
  Description of Artificial Sequence: Synthetic oligonucleotide

SEQ ID NO: 422863 - DNA, 30 bp, Artificial Sequence; identical to SEQ ID NO: 74352
  Description of Artificial Sequence: Synthetic oligonucleotide

SEQ ID NO: 422864 - DNA, 29 bp, Artificial Sequence
  Description of Artificial Sequence: Synthetic oligonucleotide
ccataatggagactggaccttccagaccc

SEQ ID NO: 422865 - DNA, 30 bp, Artificial Sequence; identical to SEQ ID NO: 74354
  Description of Artificial Sequence: Synthetic oligonucleotide

SEQ ID NO: 422866 - DNA, 30 bp, Artificial Sequence; identical to SEQ ID NO: 74355
  Description of Artificial Sequence: Synthetic oligonucleotide

SEQ ID NO: 422867 - DNA, 29 bp, Artificial Sequence
  Description of Artificial Sequence: Synthetic oligonucleotide
taatggagactggaccttccagaccctgg

SEQ ID NO: 422868 - DNA, 30 bp, Artificial Sequence; identical to SEQ ID NO: 74357
  Description of Artificial Sequence: Synthetic oligonucleotide

SEQ ID NO: 422869 - DNA, 29 bp, Artificial Sequence
  Description of Artificial Sequence: Synthetic oligonucleotide
tgccaagtggagcacccaagcgtaacaag

SEQ ID NO: 422870 - DNA, 28 bp, Artificial Sequence
  Description of Artificial Sequence: Synthetic oligonucleotide
gccaagtggagcacccaagcgtaacaag

SEQ ID NO: 422871 - DNA, 28 bp, Artificial Sequence
  Description of Artificial Sequence: Synthetic oligonucleotide
ccaagtggagcacccaagcgtaacaagc

SEQ ID NO: 422872 - DNA, 28 bp, Artificial Sequence
  Description of Artificial Sequence: Synthetic oligonucleotide
caagtggagcacccaagcgtaacaagcc

SEQ ID NO: 422873 - DNA, 28 bp, Artificial Sequence
  Description of Artificial Sequence: Synthetic oligonucleotide
aagtggagcacccaagcgtaacaagccc

SEQ ID NO: 422874 - DNA, 27 bp, Artificial Sequence
  Description of Artificial Sequence: Synthetic oligonucleotide
agtggagcacccaagcgtaacaagccc

SEQ ID NO: 422875 - DNA, 27 bp, Artificial Sequence
  Description of Artificial Sequence: Synthetic oligonucleotide
gtggagcacccaagcgtaacaagccct

SEQ ID NO: 422876 - DNA, 27 bp, Artificial Sequence
  Description of Artificial Sequence: Synthetic oligonucleotide
tggagcacccaagcgtaacaagccctc

SEQ ID NO: 422877 - DNA, 27 bp, Artificial Sequence
  Description of Artificial Sequence: Synthetic oligonucleotide
ggagcacccaagcgtaacaagccctct

SEQ ID NO: 422878 - DNA, 27 bp, Artificial Sequence
  Description of Artificial Sequence: Synthetic oligonucleotide
gagcacccaagcgtaacaagccctctc

SEQ ID NO: 422879 - DNA, 28 bp, Artificial Sequence
  Description of Artificial Sequence: Synthetic oligonucleotide
agcacccaagcgtaacaagccctctcac

SEQ ID NO: 422880 - DNA, 27 bp, Artificial Sequence
  Description of Artificial Sequence: Synthetic oligonucleotide
gcacccaagcgtaacaagccctctcac

SEQ ID NO: 422881 - DNA, 28 bp, Artificial Sequence
  Description of Artificial Sequence: Synthetic oligonucleotide
cacccaagcgtaacaagccctctcacag

SEQ ID NO: 422882 - DNA, 29 bp, Artificial Sequence
  Description of Artificial Sequence: Synthetic oligonucleotide
acccaagcgtaacaagccctctcacagtg

SEQ ID NO: 422883 - DNA, 28 bp, Artificial Sequence
  Description of Artificial Sequence: Synthetic oligonucleotide
cccaagcgtaacaagccctctcacagtg

SEQ ID NO: 422884 - DNA, 28 bp, Artificial Sequence
  Description of Artificial Sequence: Synthetic oligonucleotide
ccaagcgtaacaagccctctcacagtgg

SEQ ID NO: 422885 - DNA, 31 bp, Artificial Sequence; identical to SEQ ID NO: 74374
  Description of Artificial Sequence: Synthetic oligonucleotide

SEQ ID NO: 422886 - DNA, 31 bp, Artificial Sequence; identical to SEQ ID NO: 74375
  Description of Artificial Sequence: Synthetic oligonucleotide

SEQ ID NO: 422887 - DNA, 30 bp, Artificial Sequence; identical to SEQ ID NO: 74376
  Description of Artificial Sequence: Synthetic oligonucleotide

SEQ ID NO: 422888 - DNA, 29 bp, Artificial Sequence
  Description of Artificial Sequence: Synthetic oligonucleotide
gcgtaacaagccctctcacagtggaatgg

SEQ ID NO: 422889 - DNA, 30 bp, Artificial Sequence; identical to SEQ ID NO: 74378
  Description of Artificial Sequence: Synthetic oligonucleotide

SEQ ID NO: 422890 - DNA, 31 bp, Artificial Sequence; identical to SEQ ID NO: 74379
  Description of Artificial Sequence: Synthetic oligonucleotide

SEQ ID NO: 422891 - DNA, 31 bp, Artificial Sequence; identical to SEQ ID NO: 74380
  Description of Artificial Sequence: Synthetic oligonucleotide

SEQ ID NO: 422892 - DNA, 30 bp, Artificial Sequence; identical to SEQ ID NO: 74381
  Description of Artificial Sequence: Synthetic oligonucleotide

SEQ ID NO: 422893 - DNA, 32 bp, Artificial Sequence; identical to SEQ ID NO: 74382
  Description of Artificial Sequence: Synthetic oligonucleotide

SEQ ID NO: 422894 - DNA, 31 bp, Artificial Sequence; identical to SEQ ID NO: 74383
  Description of Artificial Sequence: Synthetic oligonucleotide

SEQ ID NO: 422895 - DNA, 31 bp, Artificial Sequence; identical to SEQ ID NO: 74384
  Description of Artificial Sequence: Synthetic oligonucleotide

SEQ ID NO: 422896 - DNA, 33 bp, Artificial Sequence; identical to SEQ ID NO: 74385
  Description of Artificial Sequence: Synthetic oligonucleotide

SEQ ID NO: 422897 - DNA, 32 bp, Artificial Sequence; identical to SEQ ID NO: 74386
  Description of Artificial Sequence: Synthetic oligonucleotide

SEQ ID NO: 422898 - DNA, 33 bp, Artificial Sequence; identical to SEQ ID NO: 74387
  Description of Artificial Sequence: Synthetic oligonucleotide

SEQ ID NO: 422899 - DNA, 33 bp, Artificial Sequence; identical to SEQ ID NO: 74388
  Description of Artificial Sequence: Synthetic oligonucleotide

SEQ ID NO: 422900 - DNA, 32 bp, Artificial Sequence; identical to SEQ ID NO: 74389
  Description of Artificial Sequence: Synthetic oligonucleotide

SEQ ID NO: 422901 - DNA, 33 bp, Artificial Sequence; identical to SEQ ID NO: 74390
  Description of Artificial Sequence: Synthetic oligonucleotide

SEQ ID NO: 422902 - DNA, 32 bp, Artificial Sequence; identical to SEQ ID NO: 74391
  Description of Artificial Sequence: Synthetic oligonucleotide

SEQ ID NO: 422903 - DNA, 31 bp, Artificial Sequence; identical to SEQ ID NO: 74392
  Description of Artificial Sequence: Synthetic oligonucleotide

SEQ ID NO: 422904 - DNA, 30 bp, Artificial Sequence; identical to SEQ ID NO: 74393
  Description of Artificial Sequence: Synthetic oligonucleotide

SEQ ID NO: 422905 - DNA, 29 bp, Artificial Sequence
  Description of Artificial Sequence: Synthetic oligonucleotide
actgcagacacaactacggcgttgtggag

SEQ ID NO: 422906 - DNA, 28 bp, Artificial Sequence
  Description of Artificial Sequence: Synthetic oligonucleotide
ctgcagacacaactacggcgttgtggag

SEQ ID NO: 422907 - DNA, 29 bp, Artificial Sequence
  Description of Artificial Sequence: Synthetic oligonucleotide
tgcagacacaactacggcgttgtggagag

SEQ ID NO: 422908 - DNA, 28 bp, Artificial Sequence
  Description of Artificial Sequence: Synthetic oligonucleotide
gcagacacaactacggcgttgtggagag

SEQ ID NO: 422909 - DNA, 28 bp, Artificial Sequence
  Description of Artificial Sequence: Synthetic oligonucleotide
cagacacaactacggcgttgtggagagc

SEQ ID NO: 422910 - DNA, 30 bp, Artificial Sequence; identical to SEQ ID NO: 74399
  Description of Artificial Sequence: Synthetic oligonucleotide

SEQ ID NO: 422911 - DNA, 29 bp, Artificial Sequence
  Description of Artificial Sequence: Synthetic oligonucleotide
gacacaactacggcgttgtggagagcttc

SEQ ID NO: 422912 - DNA, 30 bp, Artificial Sequence; identical to SEQ ID NO: 74401
  Description of Artificial Sequence: Synthetic oligonucleotide

SEQ ID NO: 422913 - DNA, 29 bp, Artificial Sequence
  Description of Artificial Sequence: Synthetic oligonucleotide
cacaactacggcgttgtggagagcttcac

SEQ ID NO: 422914 - DNA, 30 bp, Artificial Sequence; identical to SEQ ID NO: 74403
  Description of Artificial Sequence: Synthetic oligonucleotide

SEQ ID NO: 422915 - DNA, 29 bp, Artificial Sequence
  Description of Artificial Sequence: Synthetic oligonucleotide
caactacggcgttgtggagagcttcacag

SEQ ID NO: 422916 - DNA, 30 bp, Artificial Sequence; identical to SEQ ID NO: 74405
  Description of Artificial Sequence: Synthetic oligonucleotide

SEQ ID NO: 422917 - DNA, 29 bp, Artificial Sequence
  Description of Artificial Sequence: Synthetic oligonucleotide
actacggcgttgtggagagcttcacagtg

SEQ ID NO: 422918 - DNA, 28 bp, Artificial Sequence
  Description of Artificial Sequence: Synthetic oligonucleotide
ctacggcgttgtggagagcttcacagtg

SEQ ID NO: 422919 - DNA, 28 bp, Artificial Sequence
  Description of Artificial Sequence: Synthetic oligonucleotide
tacggcgttgtggagagcttcacagtgc

SEQ ID NO: 422920 - DNA, 27 bp, Artificial Sequence
  Description of Artificial Sequence: Synthetic oligonucleotide
acggcgttgtggagagcttcacagtgc

SEQ ID NO: 422921 - DNA, 27 bp, Artificial Sequence
  Description of Artificial Sequence: Synthetic oligonucleotide
cggcgttgtggagagcttcacagtgca

SEQ ID NO: 422922 - DNA, 27 bp, Artificial Sequence
  Description of Artificial Sequence: Synthetic oligonucleotide
ggcgttgtggagagcttcacagtgcag

SEQ ID NO: 422923 - DNA, 27 bp, Artificial Sequence
  Description of Artificial Sequence: Synthetic oligonucleotide
gcgttgtggagagcttcacagtgcagc

SEQ ID NO: 422924 - DNA, 27 bp, Artificial Sequence
  Description of Artificial Sequence: Synthetic oligonucleotide
cgttgtggagagcttcacagtgcagcg

SEQ ID NO: 422925 - DNA, 44 bp, Artificial Sequence
  Description of Artificial Sequence: Synthetic oligonucleotide
tcacaatagggacccaattaaaatgttttacatgcaactggatc

SEQ ID NO: 422926 - DNA, 43 bp, Artificial Sequence
  Description of Artificial Sequence: Synthetic oligonucleotide
cacaatagggacccaattaaaatgttttacatgcaactggatc

SEQ ID NO: 422927 - DNA, 46 bp, Artificial Sequence
  Description of Artificial Sequence: Synthetic oligonucleotide
acaatagggacccaattaaaatgttttacatgcaactggatcaaac

SEQ ID NO: 422928 - DNA, 45 bp, Artificial Sequence
  Description of Artificial Sequence: Synthetic oligonucleotide
caatagggacccaattaaaatgttttacatgcaactggatcaaac

SEQ ID NO: 422929 - DNA, 45 bp, Artificial Sequence
  Description of Artificial Sequence: Synthetic oligonucleotide
aatagggacccaattaaaatgttttacatgcaactggatcaaacc

SEQ ID NO: 422930 - DNA, 44 bp, Artificial Sequence
  Description of Artificial Sequence: Synthetic oligonucleotide
atagggacccaattaaaatgttttacatgcaactggatcaaacc

SEQ ID NO: 422931 - DNA, 43 bp, Artificial Sequence
  Description of Artificial Sequence: Synthetic oligonucleotide
tagggacccaattaaaatgttttacatgcaactggatcaaacc

SEQ ID NO: 422932 - DNA, 42 bp, Artificial Sequence
  Description of Artificial Sequence: Synthetic oligonucleotide
agggacccaattaaaatgttttacatgcaactggatcaaacc

SEQ ID NO: 422933 - DNA, 41 bp, Artificial Sequence
  Description of Artificial Sequence: Synthetic oligonucleotide
gggacccaattaaaatgttttacatgcaactggatcaaacc

SEQ ID NO: 422934 - DNA, 45 bp, Artificial Sequence
  Description of Artificial Sequence: Synthetic oligonucleotide
ggacccaattaaaatgttttacatgcaactggatcaaaccttttg

SEQ ID NO: 422935 - DNA, 46 bp, Artificial Sequence
  Description of Artificial Sequence: Synthetic oligonucleotide
gacccaattaaaatgttttacatgcaactggatcaaaccttttgag

SEQ ID NO: 422936 - DNA, 48 bp, Artificial Sequence
  Description of Artificial Sequence: Synthetic oligonucleotide
acccaattaaaatgttttacatgcaactggatcaaaccttttgagtac

SEQ ID NO: 422937 - DNA, 47 bp, Artificial Sequence
  Description of Artificial Sequence: Synthetic oligonucleotide
cccaattaaaatgttttacatgcaactggatcaaaccttttgagtac

SEQ ID NO: 422938 - DNA, 57 bp, Artificial Sequence
  Description of Artificial Sequence: Synthetic oligonucleotide
ccaattaaaatgttttacatgcaactggatcaaaccttttgagtactaaattaaaac

SEQ ID NO: 422939 - DNA, 60 bp, Artificial Sequence
  Description of Artificial Sequence: Synthetic oligonucleotide
caattaaaatgttttacatgcaactggatcaaaccttttgagtactaaattaaaacaatc

SEQ ID NO: 422940 - DNA, 60 bp, Artificial Sequence
  Description of Artificial Sequence: Synthetic oligonucleotide
aattaaaatgttttacatgcaactggatcaaaccttttgagtactaaattaaaacaatcc

SEQ ID NO: 422941 - DNA, 59 bp, Artificial Sequence
  Description of Artificial Sequence: Synthetic oligonucleotide
attaaaatgttttacatgcaactggatcaaaccttttgagtactaaattaaaacaatcc

SEQ ID NO: 422942 - DNA, 58 bp, Artificial Sequence
  Description of Artificial Sequence: Synthetic oligonucleotide
ttaaaatgttttacatgcaactggatcaaaccttttgagtactaaattaaaacaatcc

SEQ ID NO: 422943 - DNA, 57 bp, Artificial Sequence
  Description of Artificial Sequence: Synthetic oligonucleotide
taaaatgttttacatgcaactggatcaaaccttttgagtactaaattaaaacaatcc

SEQ ID NO: 422944 - DNA, 56 bp, Artificial Sequence
  Description of Artificial Sequence: Synthetic oligonucleotide
aaaatgttttacatgcaactggatcaaaccttttgagtactaaattaaaacaatcc

SEQ ID NO: 422945 - DNA, 55 bp, Artificial Sequence
  Description of Artificial Sequence: Synthetic oligonucleotide
aaatgttttacatgcaactggatcaaaccttttgagtactaaattaaaacaatcc

SEQ ID NO: 422946 - DNA, 54 bp, Artificial Sequence
  Description of Artificial Sequence: Synthetic oligonucleotide
aatgttttacatgcaactggatcaaaccttttgagtactaaattaaaacaatcc

SEQ ID NO: 422947 - DNA, 53 bp, Artificial Sequence
  Description of Artificial Sequence: Synthetic oligonucleotide
atgttttacatgcaactggatcaaaccttttgagtactaaattaaaacaatcc

SEQ ID NO: 422948 - DNA, 52 bp, Artificial Sequence
  Description of Artificial Sequence: Synthetic oligonucleotide
tgttttacatgcaactggatcaaaccttttgagtactaaattaaaacaatcc

SEQ ID NO: 422949 - DNA, 51 bp, Artificial Sequence
  Description of Artificial Sequence: Synthetic oligonucleotide
gttttacatgcaactggatcaaaccttttgagtactaaattaaaacaatcc

SEQ ID NO: 422950 - DNA, 57 bp, Artificial Sequence
  Description of Artificial Sequence: Synthetic oligonucleotide
ttttacatgcaactggatcaaaccttttgagtactaaattaaaacaatcctttaaag

SEQ ID NO: 422951 - DNA, 56 bp, Artificial Sequence
  Description of Artificial Sequence: Synthetic oligonucleotide
tttacatgcaactggatcaaaccttttgagtactaaattaaaacaatcctttaaag

SEQ ID NO: 422952 - DNA, 55 bp, Artificial Sequence
  Description of Artificial Sequence: Synthetic oligonucleotide
ttacatgcaactggatcaaaccttttgagtactaaattaaaacaatcctttaaag

SEQ ID NO: 422953 - DNA, 54 bp, Artificial Sequence
  Description of Artificial Sequence: Synthetic oligonucleotide
tacatgcaactggatcaaaccttttgagtactaaattaaaacaatcctttaaag

SEQ ID NO: 422954 - DNA, 53 bp, Artificial Sequence
  Description of Artificial Sequence: Synthetic oligonucleotide
acatgcaactggatcaaaccttttgagtactaaattaaaacaatcctttaaag

SEQ ID NO: 422955 - DNA, 52 bp, Artificial Sequence
  Description of Artificial Sequence: Synthetic oligonucleotide
catgcaactggatcaaaccttttgagtactaaattaaaacaatcctttaaag

SEQ ID NO: 422956 - DNA, 54 bp, Artificial Sequence
  Description of Artificial Sequence: Synthetic oligonucleotide
atgcaactggatcaaaccttttgagtactaaattaaaacaatcctttaaagaag

SEQ ID NO: 422957 - DNA, 53 bp, Artificial Sequence
  Description of Artificial Sequence: Synthetic oligonucleotide
tgcaactggatcaaaccttttgagtactaaattaaaacaatcctttaaagaag

SEQ ID NO: 422958 - DNA, 52 bp, Artificial Sequence
  Description of Artificial Sequence: Synthetic oligonucleotide
gcaactggatcaaaccttttgagtactaaattaaaacaatcctttaaagaag

SEQ ID NO: 422959 - DNA, 53 bp, Artificial Sequence
  Description of Artificial Sequence: Synthetic oligonucleotide
caactggatcaaaccttttgagtactaaattaaaacaatcctttaaagaagac

SEQ ID NO: 422960 - DNA, 57 bp, Artificial Sequence
  Description of Artificial Sequence: Synthetic oligonucleotide
aactggatcaaaccttttgagtactaaattaaaacaatcctttaaagaagacaattg

SEQ ID NO: 422961 - DNA, 56 bp, Artificial Sequence
  Description of Artificial Sequence: Synthetic oligonucleotide
actggatcaaaccttttgagtactaaattaaaacaatcctttaaagaagacaattg

SEQ ID NO: 422962 - DNA, 55 bp, Artificial Sequence
  Description of Artificial Sequence: Synthetic oligonucleotide
ctggatcaaaccttttgagtactaaattaaaacaatcctttaaagaagacaattg

SEQ ID NO: 422963 - DNA, 58 bp, Artificial Sequence
  Description of Artificial Sequence: Synthetic oligonucleotide
tggatcaaaccttttgagtactaaattaaaacaatcctttaaagaagacaattgtttc

SEQ ID NO: 422964 - DNA, 57 bp, Artificial Sequence
  Description of Artificial Sequence: Synthetic oligonucleotide
ggatcaaaccttttgagtactaaattaaaacaatcctttaaagaagacaattgtttc

SEQ ID NO: 422965 - DNA, 58 bp, Artificial Sequence
  Description of Artificial Sequence: Synthetic oligonucleotide
gatcaaaccttttgagtactaaattaaaacaatcctttaaagaagacaattgtttcag

SEQ ID NO: 422966 - DNA, 59 bp, Artificial Sequence
  Description of Artificial Sequence: Synthetic oligonucleotide
atcaaaccttttgagtactaaattaaaacaatcctttaaagaagacaattgtttcagag

SEQ ID NO: 422967 - DNA, 58 bp, Artificial Sequence
  Description of Artificial Sequence: Synthetic oligonucleotide
tcaaaccttttgagtactaaattaaaacaatcctttaaagaagacaattgtttcagag

SEQ ID NO: 422968 - DNA, 57 bp, Artificial Sequence
  Description of Artificial Sequence: Synthetic oligonucleotide
caaaccttttgagtactaaattaaaacaatcctttaaagaagacaattgtttcagag

SEQ ID NO: 422969 - DNA, 57 bp, Artificial Sequence
  Description of Artificial Sequence: Synthetic oligonucleotide
aaaccttttgagtactaaattaaaacaatcctttaaagaagacaattgtttcagagg

SEQ ID NO: 422970 - DNA, 56 bp, Artificial Sequence
  Description of Artificial Sequence: Synthetic oligonucleotide
aaccttttgagtactaaattaaaacaatcctttaaagaagacaattgtttcagagg

SEQ ID NO: 422971 - DNA, 55 bp, Artificial Sequence
  Description of Artificial Sequence: Synthetic oligonucleotide
accttttgagtactaaattaaaacaatcctttaaagaagacaattgtttcagagg

SEQ ID NO: 422972 - DNA, 54 bp, Artificial Sequence
  Description of Artificial Sequence: Synthetic oligonucleotide
ccttttgagtactaaattaaaacaatcctttaaagaagacaattgtttcagagg

SEQ ID NO: 422973 - DNA, 55 bp, Artificial Sequence
  Description of Artificial Sequence: Synthetic oligonucleotide
cttttgagtactaaattaaaacaatcctttaaagaagacaattgtttcagaggag

SEQ ID NO: 422974 - DNA, 55 bp, Artificial Sequence
  Description of Artificial Sequence: Synthetic oligonucleotide
ttttgagtactaaattaaaacaatcctttaaagaagacaattgtttcagaggagg

SEQ ID NO: 422975 - DNA, 54 bp, Artificial Sequence
  Description of Artificial Sequence: Synthetic oligonucleotide
tttgagtactaaattaaaacaatcctttaaagaagacaattgtttcagaggagg

SEQ ID NO: 422976 - DNA, 53 bp, Artificial Sequence
  Description of Artificial Sequence: Synthetic oligonucleotide
ttgagtactaaattaaaacaatcctttaaagaagacaattgtttcagaggagg

SEQ ID NO: 422977 - DNA, 52 bp, Artificial Sequence
  Description of Artificial Sequence: Synthetic oligonucleotide
tgagtactaaattaaaacaatcctttaaagaagacaattgtttcagaggagg

SEQ ID NO: 422978 - DNA, 51 bp, Artificial Sequence
  Description of Artificial Sequence: Synthetic oligonucleotide
gagtactaaattaaaacaatcctttaaagaagacaattgtttcagaggagg

SEQ ID NO: 422979 - DNA, 52 bp, Artificial Sequence
  Description of Artificial Sequence: Synthetic oligonucleotide
agtactaaattaaaacaatcctttaaagaagacaattgtttcagaggaggac

SEQ ID NO: 422980 - DNA, 51 bp, Artificial Sequence
  Description of Artificial Sequence: Synthetic oligonucleotide
gtactaaattaaaacaatcctttaaagaagacaattgtttcagaggaggac

SEQ ID NO: 422981 - DNA, 51 bp, Artificial Sequence
  Description of Artificial Sequence: Synthetic oligonucleotide
tactaaattaaaacaatcctttaaagaagacaattgtttcagaggaggacc

SEQ ID NO: 422982 - DNA, 50 bp, Artificial Sequence
  Description of Artificial Sequence: Synthetic oligonucleotide
actaaattaaaacaatcctttaaagaagacaattgtttcagaggaggacc

SEQ ID NO: 422983 - DNA, 49 bp, Artificial Sequence
  Description of Artificial Sequence: Synthetic oligonucleotide
ctaaattaaaacaatcctttaaagaagacaattgtttcagaggaggacc

SEQ ID NO: 422984 - DNA, 51 bp, Artificial Sequence
  Description of Artificial Sequence: Synthetic oligonucleotide
taaattaaaacaatcctttaaagaagacaattgtttcagaggaggaccttc

SEQ ID NO: 422985 - DNA, 50 bp, Artificial Sequence
  Description of Artificial Sequence: Synthetic oligonucleotide
aaattaaaacaatcctttaaagaagacaattgtttcagaggaggaccttc

SEQ ID NO: 422986 - DNA, 49 bp, Artificial Sequence
  Description of Artificial Sequence: Synthetic oligonucleotide
aattaaaacaatcctttaaagaagacaattgtttcagaggaggaccttc

SEQ ID NO: 422987 - DNA, 48 bp, Artificial Sequence
  Description of Artificial Sequence: Synthetic oligonucleotide
attaaaacaatcctttaaagaagacaattgtttcagaggaggaccttc

SEQ ID NO: 422988 - DNA, 47 bp, Artificial Sequence
  Description of Artificial Sequence: Synthetic oligonucleotide
ttaaaacaatcctttaaagaagacaattgtttcagaggaggaccttc

SEQ ID NO: 422989 - DNA, 46 bp, Artificial Sequence
  Description of Artificial Sequence: Synthetic oligonucleotide
taaaacaatcctttaaagaagacaattgtttcagaggaggaccttc

SEQ ID NO: 422990 - DNA, 45 bp, Artificial Sequence
  Description of Artificial Sequence: Synthetic oligonucleotide
aaaacaatcctttaaagaagacaattgtttcagaggaggaccttc

SEQ ID NO: 422991 - DNA, 44 bp, Artificial Sequence
  Description of Artificial Sequence: Synthetic oligonucleotide
aaacaatcctttaaagaagacaattgtttcagaggaggaccttc

SEQ ID NO: 422992 - DNA, 43 bp, Artificial Sequence
  Description of Artificial Sequence: Synthetic oligonucleotide
aacaatcctttaaagaagacaattgtttcagaggaggaccttc

SEQ ID NO: 422993 - DNA, 42 bp, Artificial Sequence
  Description of Artificial Sequence: Synthetic oligonucleotide
acaatcctttaaagaagacaattgtttcagaggaggaccttc

SEQ ID NO: 422994 - DNA, 41 bp, Artificial Sequence
  Description of Artificial Sequence: Synthetic oligonucleotide
caatcctttaaagaagacaattgtttcagaggaggaccttc

SEQ ID NO: 422995 - DNA, 44 bp, Artificial Sequence
  Description of Artificial Sequence: Synthetic oligonucleotide
aatcctttaaagaagacaattgtttcagaggaggaccttcatac

SEQ ID NO: 422996 - DNA, 43 bp, Artificial Sequence
  Description of Artificial Sequence: Synthetic oligonucleotide
atcctttaaagaagacaattgtttcagaggaggaccttcatac

SEQ ID NO: 422997 - DNA, 42 bp, Artificial Sequence
  Description of Artificial Sequence: Synthetic oligonucleotide
tcctttaaagaagacaattgtttcagaggaggaccttcatac

SEQ ID NO: 422998 - DNA, 41 bp, Artificial Sequence
  Description of Artificial Sequence: Synthetic oligonucleotide
cctttaaagaagacaattgtttcagaggaggaccttcatac

SEQ ID NO: 422999 - DNA, 42 bp, Artificial Sequence
  Description of Artificial Sequence: Synthetic oligonucleotide
ctttaaagaagacaattgtttcagaggaggaccttcatacag

SEQ ID NO: 423000 - DNA, 42 bp, Artificial Sequence
  Description of Artificial Sequence: Synthetic oligonucleotide
tttaaagaagacaattgtttcagaggaggaccttcatacagc

SEQ ID NO: 423001 - DNA, 41 bp, Artificial Sequence
  Description of Artificial Sequence: Synthetic oligonucleotide
ttaaagaagacaattgtttcagaggaggaccttcatacagc

SEQ ID NO: 423002 - DNA, 40 bp, Artificial Sequence
  Description of Artificial Sequence: Synthetic oligonucleotide
taaagaagacaattgtttcagaggaggaccttcatacagc

SEQ ID NO: 423003 - DNA, 39 bp, Artificial Sequence
  Description of Artificial Sequence: Synthetic oligonucleotide
aaagaagacaattgtttcagaggaggaccttcatacagc

SEQ ID NO: 423004 - DNA, 38 bp, Artificial Sequence
  Description of Artificial Sequence: Synthetic oligonucleotide
aagaagacaattgtttcagaggaggaccttcatacagc

SEQ ID NO: 423005 - DNA, 37 bp, Artificial Sequence
  Description of Artificial Sequence: Synthetic oligonucleotide
agaagacaattgtttcagaggaggaccttcatacagc

SEQ ID NO: 423006 - DNA, 36 bp, Artificial Sequence
  Description of Artificial Sequence: Synthetic oligonucleotide
gaagacaattgtttcagaggaggaccttcatacagc

SEQ ID NO: 423007 - DNA, 38 bp, Artificial Sequence
  Description of Artificial Sequence: Synthetic oligonucleotide
aagacaattgtttcagaggaggaccttcatacagcatc

SEQ ID NO: 423008 - DNA, 37 bp, Artificial Sequence
  Description of Artificial Sequence: Synthetic oligonucleotide
agacaattgtttcagaggaggaccttcatacagcatc

SEQ ID NO: 423009 - DNA, 36 bp, Artificial Sequence
  Description of Artificial Sequence: Synthetic oligonucleotide
gacaattgtttcagaggaggaccttcatacagcatc

SEQ ID NO: 423010 - DNA, 37 bp, Artificial Sequence
  Description of Artificial Sequence: Synthetic oligonucleotide
acaattgtttcagaggaggaccttcatacagcatctc

SEQ ID NO: 423011 - DNA, 36 bp, Artificial Sequence
  Description of Artificial Sequence: Synthetic oligonucleotide
caattgtttcagaggaggaccttcatacagcatctc

SEQ ID NO: 423012 - DNA, 37 bp, Artificial Sequence
  Description of Artificial Sequence: Synthetic oligonucleotide
aattgtttcagaggaggaccttcatacagcatctctg

SEQ ID NO: 423013 - DNA, 36 bp, Artificial Sequence
  Description of Artificial Sequence: Synthetic oligonucleotide
attgtttcagaggaggaccttcatacagcatctctg

SEQ ID NO: 423014 - DNA, 35 bp, Artificial Sequence
  Description of Artificial Sequence: Synthetic oligonucleotide
ttgtttcagaggaggaccttcatacagcatctctg

SEQ ID NO: 423015 - DNA, 34 bp, Artificial Sequence
  Description of Artificial Sequence: Synthetic oligonucleotide
tgtttcagaggaggaccttcatacagcatctctg

SEQ ID NO: 423016 - DNA, 33 bp, Artificial Sequence
  Description of Artificial Sequence: Synthetic oligonucleotide
gtttcagaggaggaccttcatacagcatctctg

SEQ ID NO: 423017 - DNA, 34 bp, Artificial Sequence
  Description of Artificial Sequence: Synthetic oligonucleotide
tttcagaggaggaccttcatacagcatctctgac

SEQ ID NO: 423018 - DNA, 33 bp, Artificial Sequence
  Description of Artificial Sequence: Synthetic oligonucleotide
ttcagaggaggaccttcatacagcatctctgac

SEQ ID NO: 423019 - DNA, 32 bp, Artificial Sequence
  Description of Artificial Sequence: Synthetic oligonucleotide
tcagaggaggaccttcatacagcatctctgac

SEQ ID NO: 423020 - DNA, 31 bp, Artificial Sequence
  Description of Artificial Sequence: Synthetic oligonucleotide
cagaggaggaccttcatacagcatctctgac

SEQ ID NO: 423021 - DNA, 31 bp, Artificial Sequence
  Description of Artificial Sequence: Synthetic oligonucleotide
agaggaggaccttcatacagcatctctgacc

SEQ ID NO: 423022 - DNA, 30 bp, Artificial Sequence
  Description of Artificial Sequence: Synthetic oligonucleotide
gaggaggaccttcatacagcatctctgacc

SEQ ID NO: 423023 - DNA, 31 bp, Artificial Sequence
  Description of Artificial Sequence: Synthetic oligonucleotide
aggaggaccttcatacagcatctctgaccag

SEQ ID NO: 423024 - DNA, 30 bp, Artificial Sequence
  Description of Artificial Sequence: Synthetic oligonucleotide
ggaggaccttcatacagcatctctgaccag

SEQ ID NO: 423025 - DNA, 35 bp, Artificial Sequence
  Description of Artificial Sequence: Synthetic oligonucleotide
atacagcatctctgaccagcaactgatgatgctag

SEQ ID NO: 423026 - DNA, 34 bp, Artificial Sequence
  Description of Artificial Sequence: Synthetic oligonucleotide
tacagcatctctgaccagcaactgatgatgctag

SEQ ID NO: 423027 - DNA, 33 bp, Artificial Sequence
  Description of Artificial Sequence: Synthetic oligonucleotide
acagcatctctgaccagcaactgatgatgctag

SEQ ID NO: 423028 - DNA, 32 bp, Artificial Sequence
  Description of Artificial Sequence: Synthetic oligonucleotide
cagcatctctgaccagcaactgatgatgctag

SEQ ID NO: 423029 - DNA, 33 bp, Artificial Sequence
  Description of Artificial Sequence: Synthetic oligonucleotide
agcatctctgaccagcaactgatgatgctagtg

SEQ ID NO: 423030 - DNA, 32 bp, Artificial Sequence
  Description of Artificial Sequence: Synthetic oligonucleotide
gcatctctgaccagcaactgatgatgctagtg

SEQ ID NO: 423031 - DNA, 34 bp, Artificial Sequence
  Description of Artificial Sequence: Synthetic oligonucleotide
catctctgaccagcaactgatgatgctagtgaac

SEQ ID NO: 423032 - DNA, 35 bp, Artificial Sequence
  Description of Artificial Sequence: Synthetic oligonucleotide
atctctgaccagcaactgatgatgctagtgaactc

SEQ ID NO: 423033 - DNA, 34 bp, Artificial Sequence
  Description of Artificial Sequence: Synthetic oligonucleotide
tctctgaccagcaactgatgatgctagtgaactc

SEQ ID NO: 423034 - DNA, 33 bp, Artificial Sequence
  Description of Artificial Sequence: Synthetic oligonucleotide
ctctgaccagcaactgatgatgctagtgaactc

SEQ ID NO: 423035 - DNA, 34 bp, Artificial Sequence
  Description of Artificial Sequence: Synthetic oligonucleotide
tctgaccagcaactgatgatgctagtgaactcag

SEQ ID NO: 423036 - DNA, 33 bp, Artificial Sequence
  Description of Artificial Sequence: Synthetic oligonucleotide
ctgaccagcaactgatgatgctagtgaactcag

SEQ ID NO: 423037 - DNA, 35 bp, Artificial Sequence
  Description of Artificial Sequence: Synthetic oligonucleotide
tgaccagcaactgatgatgctagtgaactcagatg

SEQ ID NO: 423038 - DNA, 34 bp, Artificial Sequence
  Description of Artificial Sequence: Synthetic oligonucleotide
gaccagcaactgatgatgctagtgaactcagatg

SEQ ID NO: 423039 - DNA, 34 bp, Artificial Sequence
  Description of Artificial Sequence: Synthetic oligonucleotide
accagcaactgatgatgctagtgaactcagatgc

SEQ ID NO: 423040 - DNA, 33 bp, Artificial Sequence
  Description of Artificial Sequence: Synthetic oligonucleotide
ccagcaactgatgatgctagtgaactcagatgc

SEQ ID NO: 423041 - DNA, 34 bp, Artificial Sequence
  Description of Artificial Sequence: Synthetic oligonucleotide
cagcaactgatgatgctagtgaactcagatgctg

SEQ ID NO: 423042 - DNA, 35 bp, Artificial Sequence
  Description of Artificial Sequence: Synthetic oligonucleotide
agcaactgatgatgctagtgaactcagatgctgac

SEQ ID NO: 423043 - DNA, 34 bp, Artificial Sequence
  Description of Artificial Sequence: Synthetic oligonucleotide
gcaactgatgatgctagtgaactcagatgctgac

SEQ ID NO: 423044 - DNA, 35 bp, Artificial Sequence
  Description of Artificial Sequence: Synthetic oligonucleotide
caactgatgatgctagtgaactcagatgctgactg

SEQ ID NO: 423045 - DNA, 35 bp, Artificial Sequence
  Description of Artificial Sequence: Synthetic oligonucleotide
aactgatgatgctagtgaactcagatgctgactgg

SEQ ID NO: 423046 - DNA, 34 bp, Artificial Sequence
  Description of Artificial Sequence: Synthetic oligonucleotide
actgatgatgctagtgaactcagatgctgactgg

SEQ ID NO: 423047 - DNA, 33 bp, Artificial Sequence
  Description of Artificial Sequence: Synthetic oligonucleotide
ctgatgatgctagtgaactcagatgctgactgg

SEQ ID NO: 423048 - DNA, 35 bp, Artificial Sequence
  Description of Artificial Sequence: Synthetic oligonucleotide
tgatgatgctagtgaactcagatgctgactggttc

SEQ ID NO: 423049 - DNA, 34 bp, Artificial Sequence
  Description of Artificial Sequence: Synthetic oligonucleotide
gatgatgctagtgaactcagatgctgactggttc

SEQ ID NO: 423050 - DNA, 35 bp, Artificial Sequence
  Description of Artificial Sequence: Synthetic oligonucleotide
atgatgctagtgaactcagatgctgactggttctc

SEQ ID NO: 423051 - DNA, 34 bp, Artificial Sequence
  Description of Artificial Sequence: Synthetic oligonucleotide
tgatgctagtgaactcagatgctgactggttctc

SEQ ID NO: 423052 - DNA, 33 bp, Artificial Sequence
  Description of Artificial Sequence: Synthetic oligonucleotide
gatgctagtgaactcagatgctgactggttctc

SEQ ID NO: 423053 - DNA, 33 bp, Artificial Sequence
  Description of Artificial Sequence: Synthetic oligonucleotide
atgctagtgaactcagatgctgactggttctcc

SEQ ID NO: 423054 - DNA, 32 bp, Artificial Sequence
  Description of Artificial Sequence: Synthetic oligonucleotide
tgctagtgaactcagatgctgactggttctcc

SEQ ID NO: 423055 - DNA, 31 bp, Artificial Sequence
  Description of Artificial Sequence: Synthetic oligonucleotide
gctagtgaactcagatgctgactggttctcc

SEQ ID NO: 423056 - DNA, 33 bp, Artificial Sequence
  Description of Artificial Sequence: Synthetic oligonucleotide
ctagtgaactcagatgctgactggttctccaac

SEQ ID NO: 423057 - DNA, 34 bp, Artificial Sequence
  Description of Artificial Sequence: Synthetic oligonucleotide
tagtgaactcagatgctgactggttctccaacac

SEQ ID NO: 423058 - DNA, 33 bp, Artificial Sequence
  Description of Artificial Sequence: Synthetic oligonucleotide
agtgaactcagatgctgactggttctccaacac

SEQ ID NO: 423059 - DNA, 32 bp, Artificial Sequence
  Description of Artificial Sequence: Synthetic oligonucleotide
gtgaactcagatgctgactggttctccaacac

SEQ ID NO: 423060 - DNA, 32 bp, Artificial Sequence
  Description of Artificial Sequence: Synthetic oligonucleotide
tgaactcagatgctgactggttctccaacacg

SEQ ID NO: 423061 - DNA, 31 bp, Artificial Sequence
  Description of Artificial Sequence: Synthetic oligonucleotide
gaactcagatgctgactggttctccaacacg

SEQ ID NO: 423062 - DNA, 32 bp, Artificial Sequence
  Description of Artificial Sequence: Synthetic oligonucleotide
aactcagatgctgactggttctccaacacgag

SEQ ID NO: 423063 - DNA, 31 bp, Artificial Sequence
  Description of Artificial Sequence: Synthetic oligonucleotide
actcagatgctgactggttctccaacacgag

SEQ ID NO: 423064 - DNA, 30 bp, Artificial Sequence
  Description of Artificial Sequence: Synthetic oligonucleotide
ctcagatgctgactggttctccaacacgag

SEQ ID NO: 423065 - DNA, 34 bp, Artificial Sequence
  Description of Artificial Sequence: Synthetic oligonucleotide
tcagatgctgactggttctccaacacgagattac

SEQ ID NO: 423066 - DNA, 33 bp, Artificial Sequence
  Description of Artificial Sequence: Synthetic oligonucleotide
cagatgctgactggttctccaacacgagattac

SEQ ID NO: 423067 - DNA, 33 bp, Artificial Sequence
  Description of Artificial Sequence: Synthetic oligonucleotide
agatgctgactggttctccaacacgagattacc

SEQ ID NO: 423068 - DNA, 32 bp, Artificial Sequence
  Description of Artificial Sequence: Synthetic oligonucleotide
gatgctgactggttctccaacacgagattacc

SEQ ID NO: 423069 - DNA, 32 bp, Artificial Sequence
  Description of Artificial Sequence: Synthetic oligonucleotide
atgctgactggttctccaacacgagattaccc

SEQ ID NO: 423070 - DNA, 31 bp, Artificial Sequence
  Description of Artificial Sequence: Synthetic oligonucleotide
tgctgactggttctccaacacgagattaccc

SEQ ID NO: 423071 - DNA, 30 bp, Artificial Sequence
  Description of Artificial Sequence: Synthetic oligonucleotide
gctgactggttctccaacacgagattaccc

SEQ ID NO: 423072 - DNA, 33 bp, Artificial Sequence
  Description of Artificial Sequence: Synthetic oligonucleotide
ctgactggttctccaacacgagattacccaatc

SEQ ID NO: 423073 - DNA, 35 bp, Artificial Sequence
  Description of Artificial Sequence: Synthetic oligonucleotide
tgactggttctccaacacgagattacccaatcaag

SEQ ID NO: 423074 - DNA, 34 bp, Artificial Sequence
  Description of Artificial Sequence: Synthetic oligonucleotide
gactggttctccaacacgagattacccaatcaag

SEQ ID NO: 423075 - DNA, 34 bp, Artificial Sequence
  Description of Artificial Sequence: Synthetic oligonucleotide
actggttctccaacacgagattacccaatcaagg

SEQ ID NO: 423076 - DNA, 33 bp, Artificial Sequence
  Description of Artificial Sequence: Synthetic oligonucleotide
ctggttctccaacacgagattacccaatcaagg

SEQ ID NO: 423077 - DNA, 34 bp, Artificial Sequence
  Description of Artificial Sequence: Synthetic oligonucleotide
tggttctccaacacgagattacccaatcaaggag

SEQ ID NO: 423078 - DNA, 33 bp, Artificial Sequence
  Description of Artificial Sequence: Synthetic oligonucleotide
ggttctccaacacgagattacccaatcaaggag

SEQ ID NO: 423079 - DNA, 33 bp, Artificial Sequence
  Description of Artificial Sequence: Synthetic oligonucleotide
gttctccaacacgagattacccaatcaaggagc

SEQ ID NO: 423080 - DNA, 35 bp, Artificial Sequence
  Description of Artificial Sequence: Synthetic oligonucleotide
ttctccaacacgagattacccaatcaaggagcaag

SEQ ID NO: 423081 - DNA, 34 bp, Artificial Sequence
  Description of Artificial Sequence: Synthetic oligonucleotide
tctccaacacgagattacccaatcaaggagcaag

SEQ ID NO: 423082 - DNA, 33 bp, Artificial Sequence
  Description of Artificial Sequence: Synthetic oligonucleotide
ctccaacacgagattacccaatcaaggagcaag

SEQ ID NO: 423083 - DNA, 33 bp, Artificial Sequence
  Description of Artificial Sequence: Synthetic oligonucleotide
tccaacacgagattacccaatcaaggagcaagg

SEQ ID NO: 423084 - DNA, 32 bp, Artificial Sequence
  Description of Artificial Sequence: Synthetic oligonucleotide
ccaacacgagattacccaatcaaggagcaagg

SEQ ID NO: 423085 - DNA, 36 bp, Artificial Sequence
  Description of Artificial Sequence: Synthetic oligonucleotide
caacacgagattacccaatcaaggagcaaggaaatc

SEQ ID NO: 423086 - DNA, 37 bp, Artificial Sequence
  Description of Artificial Sequence: Synthetic oligonucleotide
aacacgagattacccaatcaaggagcaaggaaatcag

SEQ ID NO: 423087 - DNA, 36 bp, Artificial Sequence
  Description of Artificial Sequence: Synthetic oligonucleotide
acacgagattacccaatcaaggagcaaggaaatcag

SEQ ID NO: 423088 - DNA, 35 bp, Artificial Sequence
  Description of Artificial Sequence: Synthetic oligonucleotide
cacgagattacccaatcaaggagcaaggaaatcag

SEQ ID NO: 423089 - DNA, 38 bp, Artificial Sequence
  Description of Artificial Sequence: Synthetic oligonucleotide
acgagattacccaatcaaggagcaaggaaatcagtaac

SEQ ID NO: 423090 - DNA, 37 bp, Artificial Sequence
  Description of Artificial Sequence: Synthetic oligonucleotide
cgagattacccaatcaaggagcaaggaaatcagtaac

SEQ ID NO: 423091 - DNA, 39 bp, Artificial Sequence
  Description of Artificial Sequence: Synthetic oligonucleotide
gagattacccaatcaaggagcaaggaaatcagtaacttc

SEQ ID NO: 423092 - DNA, 39 bp, Artificial Sequence
  Description of Artificial Sequence: Synthetic oligonucleotide
agattacccaatcaaggagcaaggaaatcagtaacttcc

SEQ ID NO: 423093 - DNA, 38 bp, Artificial Sequence
  Description of Artificial Sequence: Synthetic oligonucleotide
gattacccaatcaaggagcaaggaaatcagtaacttcc

SEQ ID NO: 423094 - DNA, 40 bp, Artificial Sequence
  Description of Artificial Sequence: Synthetic oligonucleotide
attacccaatcaaggagcaaggaaatcagtaacttccttc

SEQ ID NO: 423095 - DNA, 39 bp, Artificial Sequence
  Description of Artificial Sequence: Synthetic oligonucleotide
ttacccaatcaaggagcaaggaaatcagtaacttccttc

SEQ ID NO: 423096 - DNA, 38 bp, Artificial Sequence
  Description of Artificial Sequence: Synthetic oligonucleotide
tacccaatcaaggagcaaggaaatcagtaacttccttc

SEQ ID NO: 423097 - DNA, 37 bp, Artificial Sequence
  Description of Artificial Sequence: Synthetic oligonucleotide
acccaatcaaggagcaaggaaatcagtaacttccttc

SEQ ID NO: 423098 - DNA, 36 bp, Artificial Sequence
  Description of Artificial Sequence: Synthetic oligonucleotide
cccaatcaaggagcaaggaaatcagtaacttccttc

SEQ ID NO: 423099 - DNA, 36 bp, Artificial Sequence
  Description of Artificial Sequence: Synthetic oligonucleotide
ccaatcaaggagcaaggaaatcagtaacttccttcc

SEQ ID NO: 423100 - DNA, 44 bp, Artificial Sequence
  Description of Artificial Sequence: Synthetic oligonucleotide
caatcaaggagcaaggaaatcagtaacttccttcctataatttg

SEQ ID NO: 423101 - DNA, 48 bp, Artificial Sequence
  Description of Artificial Sequence: Synthetic oligonucleotide
aatcaaggagcaaggaaatcagtaacttccttcctataatttgaaatg

SEQ ID NO: 423102 - DNA, 47 bp, Artificial Sequence
  Description of Artificial Sequence: Synthetic oligonucleotide
atcaaggagcaaggaaatcagtaacttccttcctataatttgaaatg

SEQ ID NO: 423103 - DNA, 46 bp, Artificial Sequence
  Description of Artificial Sequence: Synthetic oligonucleotide
tcaaggagcaaggaaatcagtaacttccttcctataatttgaaatg

SEQ ID NO: 423104 - DNA, 45 bp, Artificial Sequence
  Description of Artificial Sequence: Synthetic oligonucleotide
caaggagcaaggaaatcagtaacttccttcctataatttgaaatg

SEQ ID NO: 423105 - DNA, 46 bp, Artificial Sequence
  Description of Artificial Sequence: Synthetic oligonucleotide
aaggagcaaggaaatcagtaacttccttcctataatttgaaatgtg

SEQ ID NO: 423106 - DNA, 45 bp, Artificial Sequence
  Description of Artificial Sequence: Synthetic oligonucleotide
aggagcaaggaaatcagtaacttccttcctataatttgaaatgtg

SEQ ID NO: 423107 - DNA, 44 bp, Artificial Sequence
  Description of Artificial Sequence: Synthetic oligonucleotide
ggagcaaggaaatcagtaacttccttcctataatttgaaatgtg

SEQ ID NO: 423108 - DNA, 44 bp, Artificial Sequence
  Description of Artificial Sequence: Synthetic oligonucleotide
gagcaaggaaatcagtaacttccttcctataatttgaaatgtgg

SEQ ID NO: 423109 - DNA, 44 bp, Artificial Sequence
  Description of Artificial Sequence: Synthetic oligonucleotide
agcaaggaaatcagtaacttccttcctataatttgaaatgtggg

SEQ ID NO: 423110 - DNA, 43 bp, Artificial Sequence
  Description of Artificial Sequence: Synthetic oligonucleotide
gcaaggaaatcagtaacttccttcctataatttgaaatgtggg

SEQ ID NO: 423111 - DNA, 44 bp, Artificial Sequence
  Description of Artificial Sequence: Synthetic oligonucleotide
caaggaaatcagtaacttccttcctataatttgaaatgtgggtg

SEQ ID NO: 423112 - DNA, 44 bp, Artificial Sequence
  Description of Artificial Sequence: Synthetic oligonucleotide
aaggaaatcagtaacttccttcctataatttgaaatgtgggtgg

SEQ ID NO: 423113 - DNA, 43 bp, Artificial Sequence
  Description of Artificial Sequence: Synthetic oligonucleotide
aggaaatcagtaacttccttcctataatttgaaatgtgggtgg

SEQ ID NO: 423114 - DNA, 42 bp, Artificial Sequence
  Description of Artificial Sequence: Synthetic oligonucleotide
ggaaatcagtaacttccttcctataatttgaaatgtgggtgg

SEQ ID NO: 423115 - DNA, 43 bp, Artificial Sequence
  Description of Artificial Sequence: Synthetic oligonucleotide
gaaatcagtaacttccttcctataatttgaaatgtgggtggag

SEQ ID NO: 423116 - DNA, 43 bp, Artificial Sequence
  Description of Artificial Sequence: Synthetic oligonucleotide
aaatcagtaacttccttcctataatttgaaatgtgggtggagg

SEQ ID NO: 423117 - DNA, 42 bp, Artificial Sequence
  Description of Artificial Sequence: Synthetic oligonucleotide
aatcagtaacttccttcctataatttgaaatgtgggtggagg

SEQ ID NO: 423118 - DNA, 41 bp, Artificial Sequence
  Description of Artificial Sequence: Synthetic oligonucleotide
atcagtaacttccttcctataatttgaaatgtgggtggagg

SEQ ID NO: 423119 - DNA, 40 bp, Artificial Sequence
  Description of Artificial Sequence: Synthetic oligonucleotide
tcagtaacttccttcctataatttgaaatgtgggtggagg

SEQ ID NO: 423120 - DNA, 39 bp, Artificial Sequence
  Description of Artificial Sequence: Synthetic oligonucleotide
cagtaacttccttcctataatttgaaatgtgggtggagg

SEQ ID NO: 423121 - DNA, 39 bp, Artificial Sequence
  Description of Artificial Sequence: Synthetic oligonucleotide
agtaacttccttcctataatttgaaatgtgggtggaggg

SEQ ID NO: 423122 - DNA, 38 bp, Artificial Sequence
  Description of Artificial Sequence: Synthetic oligonucleotide
gtaacttccttcctataatttgaaatgtgggtggaggg

SEQ ID NO: 423123 - DNA, 38 bp, Artificial Sequence
  Description of Artificial Sequence: Synthetic oligonucleotide
taacttccttcctataatttgaaatgtgggtggagggg

SEQ ID NO: 423124 - DNA, 37 bp, Artificial Sequence
  Description of Artificial Sequence: Synthetic oligonucleotide
aacttccttcctataatttgaaatgtgggtggagggg

SEQ ID NO: 423125 - DNA, 36 bp, Artificial Sequence
  Description of Artificial Sequence: Synthetic oligonucleotide
acttccttcctataatttgaaatgtgggtggagggg

SEQ ID NO: 423126 - DNA, 35 bp, Artificial Sequence
  Description of Artificial Sequence: Synthetic oligonucleotide
cttccttcctataatttgaaatgtgggtggagggg

SEQ ID NO: 423127 - DNA, 35 bp, Artificial Sequence
  Description of Artificial Sequence: Synthetic oligonucleotide
ttccttcctataatttgaaatgtgggtggaggggg

SEQ ID NO: 423128 - DNA, 34 bp, Artificial Sequence
  Description of Artificial Sequence: Synthetic oligonucleotide
tccttcctataatttgaaatgtgggtggaggggg

SEQ ID NO: 423129 - DNA, 33 bp, Artificial Sequence
  Description of Artificial Sequence: Synthetic oligonucleotide
ccttcctataatttgaaatgtgggtggaggggg

SEQ ID NO: 423130 - DNA, 33 bp, Artificial Sequence
  Description of Artificial Sequence: Synthetic oligonucleotide
cttcctataatttgaaatgtgggtggagggggg

SEQ ID NO: 423131 - DNA, 34 bp, Artificial Sequence
  Description of Artificial Sequence: Synthetic oligonucleotide
ttcctataatttgaaatgtgggtggaggggggtc

SEQ ID NO: 423132 - DNA, 33 bp, Artificial Sequence
  Description of Artificial Sequence: Synthetic oligonucleotide
tcctataatttgaaatgtgggtggaggggggtc

SEQ ID NO: 423133 - DNA, 32 bp, Artificial Sequence
  Description of Artificial Sequence: Synthetic oligonucleotide
cctataatttgaaatgtgggtggaggggggtc

SEQ ID NO: 423134 - DNA, 35 bp, Artificial Sequence
  Description of Artificial Sequence: Synthetic oligonucleotide
ctataatttgaaatgtgggtggaggggggtcatag

SEQ ID NO: 423135 - DNA, 37 bp, Artificial Sequence
  Description of Artificial Sequence: Synthetic oligonucleotide
tataatttgaaatgtgggtggaggggggtcatagttc

SEQ ID NO: 423136 - DNA, 36 bp, Artificial Sequence
  Description of Artificial Sequence: Synthetic oligonucleotide
ataatttgaaatgtgggtggaggggggtcatagttc

SEQ ID NO: 423137 - DNA, 35 bp, Artificial Sequence
  Description of Artificial Sequence: Synthetic oligonucleotide
taatttgaaatgtgggtggaggggggtcatagttc

SEQ ID NO: 423138 - DNA, 34 bp, Artificial Sequence
  Description of Artificial Sequence: Synthetic oligonucleotide
aatttgaaatgtgggtggaggggggtcatagttc

SEQ ID NO: 423139 - DNA, 33 bp, Artificial Sequence
  Description of Artificial Sequence: Synthetic oligonucleotide
atttgaaatgtgggtggaggggggtcatagttc

SEQ ID NO: 423140 - DNA, 32 bp, Artificial Sequence
  Description of Artificial Sequence: Synthetic oligonucleotide
tttgaaatgtgggtggaggggggtcatagttc

SEQ ID NO: 423141 - DNA, 31 bp, Artificial Sequence
  Description of Artificial Sequence: Synthetic oligonucleotide
ttgaaatgtgggtggaggggggtcatagttc

SEQ ID NO: 423142 - DNA, 30 bp, Artificial Sequence
  Description of Artificial Sequence: Synthetic oligonucleotide
tgaaatgtgggtggaggggggtcatagttc

SEQ ID NO: 423143 - DNA, 29 bp, Artificial Sequence
  Description of Artificial Sequence: Synthetic oligonucleotide
gaaatgtgggtggaggggggtcatagttc

SEQ ID NO: 423144 - DNA, 30 bp, Artificial Sequence
  Description of Artificial Sequence: Synthetic oligonucleotide
aaatgtgggtggaggggggtcatagttctc

SEQ ID NO: 423145 - DNA, 28 bp, Artificial Sequence
  Description of Artificial Sequence: Synthetic oligonucleotide
ctgagtgagacttgcctgctgctctgac

SEQ ID NO: 423146 - DNA, 28 bp, Artificial Sequence
  Description of Artificial Sequence: Synthetic oligonucleotide
tgagtgagacttgcctgctgctctgacc

SEQ ID NO: 423147 - DNA, 27 bp, Artificial Sequence
  Description of Artificial Sequence: Synthetic oligonucleotide
gagtgagacttgcctgctgctctgacc

SEQ ID NO: 423148 - DNA, 28 bp, Artificial Sequence
  Description of Artificial Sequence: Synthetic oligonucleotide
agtgagacttgcctgctgctctgaccac

SEQ ID NO: 423149 - DNA, 27 bp, Artificial Sequence
  Description of Artificial Sequence: Synthetic oligonucleotide
gtgagacttgcctgctgctctgaccac

SEQ ID NO: 423150 - DNA, 28 bp, Artificial Sequence
  Description of Artificial Sequence: Synthetic oligonucleotide
tgagacttgcctgctgctctgaccactg

SEQ ID NO: 423151 - DNA, 27 bp, Artificial Sequence
  Description of Artificial Sequence: Synthetic oligonucleotide
gagacttgcctgctgctctgaccactg

SEQ ID NO: 423152 - DNA, 27 bp, Artificial Sequence
  Description of Artificial Sequence: Synthetic oligonucleotide
agacttgcctgctgctctgaccactgg

SEQ ID NO: 423153 - DNA, 27 bp, Artificial Sequence
  Description of Artificial Sequence: Synthetic oligonucleotide
gacttgcctgctgctctgaccactggt

SEQ ID NO: 423154 - DNA, 27 bp, Artificial Sequence
  Description of Artificial Sequence: Synthetic oligonucleotide
acttgcctgctgctctgaccactggtc

SEQ ID NO: 423155 - DNA, 27 bp, Artificial Sequence
  Description of Artificial Sequence: Synthetic oligonucleotide
cttgcctgctgctctgaccactggtct

SEQ ID NO: 423156 - DNA, 28 bp, Artificial Sequence
  Description of Artificial Sequence: Synthetic oligonucleotide
ttgcctgctgctctgaccactggtcttg

SEQ ID NO: 423157 - DNA, 27 bp, Artificial Sequence
  Description of Artificial Sequence: Synthetic oligonucleotide
tgcctgctgctctgaccactggtcttg

SEQ ID NO: 423158 - DNA, 27 bp, Artificial Sequence
  Description of Artificial Sequence: Synthetic oligonucleotide
gcctgctgctctgaccactggtcttgt

SEQ ID NO: 423159 - DNA, 27 bp, Artificial Sequence
  Description of Artificial Sequence: Synthetic oligonucleotide
cctgctgctctgaccactggtcttgtc

SEQ ID NO: 423160 - DNA, 27 bp, Artificial Sequence
  Description of Artificial Sequence: Synthetic oligonucleotide
ctgctgctctgaccactggtcttgtcc

SEQ ID NO: 423161 - DNA, 28 bp, Artificial Sequence
  Description of Artificial Sequence: Synthetic oligonucleotide
tgctgctctgaccactggtcttgtcctc

SEQ ID NO: 423162 - DNA, 27 bp, Artificial Sequence
  Description of Artificial Sequence: Synthetic oligonucleotide
gctgctctgaccactggtcttgtcctc

SEQ ID NO: 423163 - DNA, 29 bp, Artificial Sequence
  Description of Artificial Sequence: Synthetic oligonucleotide
ctgctctgaccactggtcttgtcctcttc

SEQ ID NO: 423164 - DNA, 30 bp, Artificial Sequence
  Description of Artificial Sequence: Synthetic oligonucleotide
tgctctgaccactggtcttgtcctcttctc

SEQ ID NO: 423165 - DNA, 29 bp, Artificial Sequence
  Description of Artificial Sequence: Synthetic oligonucleotide
gctctgaccactggtcttgtcctcttctc

SEQ ID NO: 423166 - DNA, 29 bp, Artificial Sequence
  Description of Artificial Sequence: Synthetic oligonucleotide
ctctgaccactggtcttgtcctcttctcc

SEQ ID NO: 423167 - DNA, 30 bp, Artificial Sequence
  Description of Artificial Sequence: Synthetic oligonucleotide
tctgaccactggtcttgtcctcttctccag

SEQ ID NO: 423168 - DNA, 29 bp, Artificial Sequence
  Description of Artificial Sequence: Synthetic oligonucleotide
ctgaccactggtcttgtcctcttctccag

SEQ ID NO: 423169 - DNA, 29 bp, Artificial Sequence
  Description of Artificial Sequence: Synthetic oligonucleotide
tgaccactggtcttgtcctcttctccagc

SEQ ID NO: 423170 - DNA, 28 bp, Artificial Sequence
  Description of Artificial Sequence: Synthetic oligonucleotide
gaccactggtcttgtcctcttctccagc

SEQ ID NO: 423171 - DNA, 30 bp, Artificial Sequence
  Description of Artificial Sequence: Synthetic oligonucleotide
accactggtcttgtcctcttctccagcatg

SEQ ID NO: 423172 - DNA, 29 bp, Artificial Sequence
  Description of Artificial Sequence: Synthetic oligonucleotide
ccactggtcttgtcctcttctccagcatg

SEQ ID NO: 423173 - DNA, 29 bp, Artificial Sequence
  Description of Artificial Sequence: Synthetic oligonucleotide
cactggtcttgtcctcttctccagcatgg

SEQ ID NO: 423174 - DNA, 30 bp, Artificial Sequence
  Description of Artificial Sequence: Synthetic oligonucleotide
actggtcttgtcctcttctccagcatggtg

SEQ ID NO: 423175 - DNA, 29 bp, Artificial Sequence
  Description of Artificial Sequence: Synthetic oligonucleotide
ctggtcttgtcctcttctccagcatggtg

SEQ ID NO: 423176 - DNA, 30 bp, Artificial Sequence
  Description of Artificial Sequence: Synthetic oligonucleotide
tggtcttgtcctcttctccagcatggtgtg

SEQ ID NO: 423177 - DNA, 29 bp, Artificial Sequence
  Description of Artificial Sequence: Synthetic oligonucleotide
ggtcttgtcctcttctccagcatggtgtg

SEQ ID NO: 423178 - DNA, 30 bp, Artificial Sequence
  Description of Artificial Sequence: Synthetic oligonucleotide
gtcttgtcctcttctccagcatggtgtgtc

SEQ ID NO: 423179 - DNA, 31 bp, Artificial Sequence
  Description of Artificial Sequence: Synthetic oligonucleotide
tcttgtcctcttctccagcatggtgtgtctg

SEQ ID NO: 423180 - DNA, 30 bp, Artificial Sequence
  Description of Artificial Sequence: Synthetic oligonucleotide
cttgtcctcttctccagcatggtgtgtctg

SEQ ID NO: 423181 - DNA, 32 bp, Artificial Sequence
  Description of Artificial Sequence: Synthetic oligonucleotide
ttgtcctcttctccagcatggtgtgtctgaag

SEQ ID NO: 423182 - DNA, 27 bp, Artificial Sequence
  Description of Artificial Sequence: Synthetic oligonucleotide
tgtctgaagctccctggaggctcctgt

SEQ ID NO: 423183 - DNA, 27 bp, Artificial Sequence
  Description of Artificial Sequence: Synthetic oligonucleotide
gtctgaagctccctggaggctcctgta

SEQ ID NO: 423184 - DNA, 28 bp, Artificial Sequence
  Description of Artificial Sequence: Synthetic oligonucleotide
tctgaagctccctggaggctcctgtatg

SEQ ID NO: 423185 - DNA, 27 bp, Artificial Sequence
  Description of Artificial Sequence: Synthetic oligonucleotide
ctgaagctccctggaggctcctgtatg

SEQ ID NO: 423186 - DNA, 27 bp, Artificial Sequence
  Description of Artificial Sequence: Synthetic oligonucleotide
tgaagctccctggaggctcctgtatgg

SEQ ID NO: 423187 - DNA, 26 bp, Artificial Sequence
  Description of Artificial Sequence: Synthetic oligonucleotide
gaagctccctggaggctcctgtatgg

SEQ ID NO: 423188 - DNA, 27 bp, Artificial Sequence
  Description of Artificial Sequence: Synthetic oligonucleotide
aagctccctggaggctcctgtatggca

SEQ ID NO: 423189 - DNA, 26 bp, Artificial Sequence
  Description of Artificial Sequence: Synthetic oligonucleotide
agctccctggaggctcctgtatggca

SEQ ID NO: 423190 - DNA, 25 bp, Artificial Sequence
  Description of Artificial Sequence: Synthetic oligonucleotide
gctccctggaggctcctgtatggca

SEQ ID NO: 423191 - DNA, 25 bp, Artificial Sequence
  Description of Artificial Sequence: Synthetic oligonucleotide
ctccctggaggctcctgtatggcag

SEQ ID NO: 423192 - DNA, 25 bp, Artificial Sequence
  Description of Artificial Sequence: Synthetic oligonucleotide
tccctggaggctcctgtatggcagc

SEQ ID NO: 423193 - DNA, 24 bp, Artificial Sequence
  Description of Artificial Sequence: Synthetic oligonucleotide
ccctggaggctcctgtatggcagc

SEQ ID NO: 423194 - DNA, 24 bp, Artificial Sequence
  Description of Artificial Sequence: Synthetic oligonucleotide
cctggaggctcctgtatggcagcg

SEQ ID NO: 423195 - DNA, 25 bp, Artificial Sequence
  Description of Artificial Sequence: Synthetic oligonucleotide
ctggaggctcctgtatggcagcgct

SEQ ID NO: 423196 - DNA, 26 bp, Artificial Sequence
  Description of Artificial Sequence: Synthetic oligonucleotide
tggaggctcctgtatggcagcgctga

SEQ ID NO: 423197 - DNA, 25 bp, Artificial Sequence
  Description of Artificial Sequence: Synthetic oligonucleotide
ggaggctcctgtatggcagcgctga

SEQ ID NO: 423198 - DNA, 26 bp, Artificial Sequence
  Description of Artificial Sequence: Synthetic oligonucleotide
gaggctcctgtatggcagcgctgaca

SEQ ID NO: 423199 - DNA, 27 bp, Artificial Sequence
  Description of Artificial Sequence: Synthetic oligonucleotide
aggctcctgtatggcagcgctgacagt

SEQ ID NO: 423200 - DNA, 26 bp, Artificial Sequence
  Description of Artificial Sequence: Synthetic oligonucleotide
ggctcctgtatggcagcgctgacagt

SEQ ID NO: 423201 - DNA, 27 bp, Artificial Sequence
  Description of Artificial Sequence: Synthetic oligonucleotide
gctcctgtatggcagcgctgacagtga

SEQ ID NO: 423202 - DNA, 27 bp, Artificial Sequence
  Description of Artificial Sequence: Synthetic oligonucleotide
ctcctgtatggcagcgctgacagtgac

SEQ ID NO: 423203 - DNA, 30 bp, Artificial Sequence; identical to SEQ ID NO: 74435
  Description of Artificial Sequence: Synthetic oligonucleotide

SEQ ID NO: 423204 - DNA, 29 bp, Artificial Sequence
  Description of Artificial Sequence: Synthetic oligonucleotide
cctgtatggcagcgctgacagtgacattg

SEQ ID NO: 423205 - DNA, 30 bp, Artificial Sequence; identical to SEQ ID NO: 74437
  Description of Artificial Sequence: Synthetic oligonucleotide

SEQ ID NO: 423206 - DNA, 30 bp, Artificial Sequence; identical to SEQ ID NO: 74438
  Description of Artificial Sequence: Synthetic oligonucleotide

SEQ ID NO: 423207 - DNA, 29 bp, Artificial Sequence
  Description of Artificial Sequence: Synthetic oligonucleotide
gtatggcagcgctgacagtgacattgacg

SEQ ID NO: 423208 - DNA, 29 bp, Artificial Sequence
  Description of Artificial Sequence: Synthetic oligonucleotide
tatggcagcgctgacagtgacattgacgg

SEQ ID NO: 423209 - DNA, 28 bp, Artificial Sequence
  Description of Artificial Sequence: Synthetic oligonucleotide
atggcagcgctgacagtgacattgacgg

SEQ ID NO: 423210 - DNA, 27 bp, Artificial Sequence
  Description of Artificial Sequence: Synthetic oligonucleotide
tggcagcgctgacagtgacattgacgg

SEQ ID NO: 423211 - DNA, 27 bp, Artificial Sequence
  Description of Artificial Sequence: Synthetic oligonucleotide
ggcagcgctgacagtgacattgacggt

SEQ ID NO: 423212 - DNA, 27 bp, Artificial Sequence
  Description of Artificial Sequence: Synthetic oligonucleotide
gcagcgctgacagtgacattgacggtg

SEQ ID NO: 423213 - DNA, 27 bp, Artificial Sequence
  Description of Artificial Sequence: Synthetic oligonucleotide
cagcgctgacagtgacattgacggtgc

SEQ ID NO: 423214 - DNA, 28 bp, Artificial Sequence
  Description of Artificial Sequence: Synthetic oligonucleotide
agcgctgacagtgacattgacggtgctg

SEQ ID NO: 423215 - DNA, 27 bp, Artificial Sequence
  Description of Artificial Sequence: Synthetic oligonucleotide
gcgctgacagtgacattgacggtgctg

SEQ ID NO: 423216 - DNA, 28 bp, Artificial Sequence
  Description of Artificial Sequence: Synthetic oligonucleotide
cgctgacagtgacattgacggtgctgag

SEQ ID NO: 423217 - DNA, 28 bp, Artificial Sequence
  Description of Artificial Sequence: Synthetic oligonucleotide
gctgacagtgacattgacggtgctgagc

SEQ ID NO: 423218 - DNA, 29 bp, Artificial Sequence
  Description of Artificial Sequence: Synthetic oligonucleotide
ctgacagtgacattgacggtgctgagctc

SEQ ID NO: 423219 - DNA, 29 bp, Artificial Sequence
  Description of Artificial Sequence: Synthetic oligonucleotide
tgacagtgacattgacggtgctgagctcc

SEQ ID NO: 423220 - DNA, 28 bp, Artificial Sequence
  Description of Artificial Sequence: Synthetic oligonucleotide
gacagtgacattgacggtgctgagctcc

SEQ ID NO: 423221 - DNA, 28 bp, Artificial Sequence
  Description of Artificial Sequence: Synthetic oligonucleotide
acagtgacattgacggtgctgagctccc

SEQ ID NO: 423222 - DNA, 27 bp, Artificial Sequence
  Description of Artificial Sequence: Synthetic oligonucleotide
cagtgacattgacggtgctgagctccc

SEQ ID NO: 423223 - DNA, 27 bp, Artificial Sequence
  Description of Artificial Sequence: Synthetic oligonucleotide
agtgacattgacggtgctgagctcccc

SEQ ID NO: 423224 - DNA, 27 bp, Artificial Sequence
  Description of Artificial Sequence: Synthetic oligonucleotide
gtgacattgacggtgctgagctcccca

SEQ ID NO: 423225 - DNA, 27 bp, Artificial Sequence
  Description of Artificial Sequence: Synthetic oligonucleotide
tgacattgacggtgctgagctccccac

SEQ ID NO: 423226 - DNA, 27 bp, Artificial Sequence
  Description of Artificial Sequence: Synthetic oligonucleotide
gacattgacggtgctgagctccccact

SEQ ID NO: 423227 - DNA, 27 bp, Artificial Sequence
  Description of Artificial Sequence: Synthetic oligonucleotide
acattgacggtgctgagctccccactg

SEQ ID NO: 423228 - DNA, 26 bp, Artificial Sequence
  Description of Artificial Sequence: Synthetic oligonucleotide
cattgacggtgctgagctccccactg

SEQ ID NO: 423229 - DNA, 26 bp, Artificial Sequence
  Description of Artificial Sequence: Synthetic oligonucleotide
attgacggtgctgagctccccactgg

SEQ ID NO: 423230 - DNA, 25 bp, Artificial Sequence
  Description of Artificial Sequence: Synthetic oligonucleotide
ttgacggtgctgagctccccactgg

SEQ ID NO: 423231 - DNA, 24 bp, Artificial Sequence
  Description of Artificial Sequence: Synthetic oligonucleotide
tgacggtgctgagctccccactgg

SEQ ID NO: 423232 - DNA, 23 bp, Artificial Sequence
  Description of Artificial Sequence: Synthetic oligonucleotide
gacggtgctgagctccccactgg

SEQ ID NO: 423233 - DNA, 26 bp, Artificial Sequence
  Description of Artificial Sequence: Synthetic oligonucleotide
acggtgctgagctccccactggcttt

SEQ ID NO: 423234 - DNA, 25 bp, Artificial Sequence
  Description of Artificial Sequence: Synthetic oligonucleotide
cggtgctgagctccccactggcttt

SEQ ID NO: 423235 - DNA, 27 bp, Artificial Sequence
  Description of Artificial Sequence: Synthetic oligonucleotide
ctggggacacccaaccacgtttcttgg

SEQ ID NO: 423236 - DNA, 28 bp, Artificial Sequence
  Description of Artificial Sequence: Synthetic oligonucleotide
tggggacacccaaccacgtttcttggag

SEQ ID NO: 423237 - DNA, 27 bp, Artificial Sequence
  Description of Artificial Sequence: Synthetic oligonucleotide
ggggacacccaaccacgtttcttggag

SEQ ID NO: 423238 - DNA, 27 bp, Artificial Sequence
  Description of Artificial Sequence: Synthetic oligonucleotide
gggacacccaaccacgtttcttggagc

SEQ ID NO: 423239 - DNA, 28 bp, Artificial Sequence
  Description of Artificial Sequence: Synthetic oligonucleotide
ggacacccaaccacgtttcttggagcag

SEQ ID NO: 423240 - DNA, 28 bp, Artificial Sequence
  Description of Artificial Sequence: Synthetic oligonucleotide
gacacccaaccacgtttcttggagcagg

SEQ ID NO: 423241 - DNA, 28 bp, Artificial Sequence
  Description of Artificial Sequence: Synthetic oligonucleotide
acacccaaccacgtttcttggagcaggc

SEQ ID NO: 423242 - DNA, 27 bp, Artificial Sequence
  Description of Artificial Sequence: Synthetic oligonucleotide
cacccaaccacgtttcttggagcaggc

SEQ ID NO: 423243 - DNA, 30 bp, Artificial Sequence; identical to SEQ ID NO: 74475
  Description of Artificial Sequence: Synthetic oligonucleotide

SEQ ID NO: 423244 - DNA, 29 bp, Artificial Sequence
  Description of Artificial Sequence: Synthetic oligonucleotide
cccaaccacgtttcttggagcaggctaag

SEQ ID NO: 423245 - DNA, 30 bp, Artificial Sequence; identical to SEQ ID NO: 74477
  Description of Artificial Sequence: Synthetic oligonucleotide

SEQ ID NO: 423246 - DNA, 31 bp, Artificial Sequence; identical to SEQ ID NO: 74478
  Description of Artificial Sequence: Synthetic oligonucleotide

SEQ ID NO: 423247 - DNA, 32 bp, Artificial Sequence; identical to SEQ ID NO: 74479
  Description of Artificial Sequence: Synthetic oligonucleotide

SEQ ID NO: 423248 - DNA, 31 bp, Artificial Sequence; identical to SEQ ID NO: 74480
  Description of Artificial Sequence: Synthetic oligonucleotide

SEQ ID NO: 423249 - DNA, 30 bp, Artificial Sequence; identical to SEQ ID NO: 74481
  Description of Artificial Sequence: Synthetic oligonucleotide

SEQ ID NO: 423250 - DNA, 31 bp, Artificial Sequence; identical to SEQ ID NO: 74482
  Description of Artificial Sequence: Synthetic oligonucleotide

SEQ ID NO: 423251 - DNA, 32 bp, Artificial Sequence; identical to SEQ ID NO: 74483
  Description of Artificial Sequence: Synthetic oligonucleotide

SEQ ID NO: 423252 - DNA, 31 bp, Artificial Sequence; identical to SEQ ID NO: 74484
  Description of Artificial Sequence: Synthetic oligonucleotide

SEQ ID NO: 423253 - DNA, 35 bp, Artificial Sequence; identical to SEQ ID NO: 74485
  Description of Artificial Sequence: Synthetic oligonucleotide

SEQ ID NO: 423254 - DNA, 35 bp, Artificial Sequence; identical to SEQ ID NO: 74486
  Description of Artificial Sequence: Synthetic oligonucleotide

SEQ ID NO: 423255 - DNA, 34 bp, Artificial Sequence; identical to SEQ ID NO: 74487
  Description of Artificial Sequence: Synthetic oligonucleotide

SEQ ID NO: 423256 - DNA, 33 bp, Artificial Sequence; identical to SEQ ID NO: 74488
  Description of Artificial Sequence: Synthetic oligonucleotide

SEQ ID NO: 423257 - DNA, 32 bp, Artificial Sequence; identical to SEQ ID NO: 74489
  Description of Artificial Sequence: Synthetic oligonucleotide

SEQ ID NO: 423258 - DNA, 33 bp, Artificial Sequence; identical to SEQ ID NO: 74490
  Description of Artificial Sequence: Synthetic oligonucleotide

SEQ ID NO: 423259 - DNA, 32 bp, Artificial Sequence; identical to SEQ ID NO: 74491
  Description of Artificial Sequence: Synthetic oligonucleotide

SEQ ID NO: 423260 - DNA, 31 bp, Artificial Sequence; identical to SEQ ID NO: 74492
  Description of Artificial Sequence: Synthetic oligonucleotide

SEQ ID NO: 423261 - DNA, 34 bp, Artificial Sequence; identical to SEQ ID NO: 74493
  Description of Artificial Sequence: Synthetic oligonucleotide

SEQ ID NO: 423262 - DNA, 34 bp, Artificial Sequence; identical to SEQ ID NO: 74494
  Description of Artificial Sequence: Synthetic oligonucleotide

SEQ ID NO: 423263 - DNA, 33 bp, Artificial Sequence; identical to SEQ ID NO: 74495
  Description of Artificial Sequence: Synthetic oligonucleotide

SEQ ID NO: 423264 - DNA, 33 bp, Artificial Sequence; identical to SEQ ID NO: 74496
  Description of Artificial Sequence: Synthetic oligonucleotide

SEQ ID NO: 423265 - DNA, 34 bp, Artificial Sequence; identical to SEQ ID NO: 74497
  Description of Artificial Sequence: Synthetic oligonucleotide

SEQ ID NO: 423266 - DNA, 33 bp, Artificial Sequence; identical to SEQ ID NO: 74498
  Description of Artificial Sequence: Synthetic oligonucleotide

SEQ ID NO: 423267 - DNA, 33 bp, Artificial Sequence; identical to SEQ ID NO: 74499
  Description of Artificial Sequence: Synthetic oligonucleotide

SEQ ID NO: 423268 - DNA, 33 bp, Artificial Sequence; identical to SEQ ID NO: 74500
  Description of Artificial Sequence: Synthetic oligonucleotide

SEQ ID NO: 423269 - DNA, 34 bp, Artificial Sequence; identical to SEQ ID NO: 74501
  Description of Artificial Sequence: Synthetic oligonucleotide

SEQ ID NO: 423270 - DNA, 33 bp, Artificial Sequence; identical to SEQ ID NO: 74502
  Description of Artificial Sequence: Synthetic oligonucleotide

SEQ ID NO: 423271 - DNA, 32 bp, Artificial Sequence; identical to SEQ ID NO: 74503
  Description of Artificial Sequence: Synthetic oligonucleotide

SEQ ID NO: 423272 - DNA, 31 bp, Artificial Sequence; identical to SEQ ID NO: 74504
  Description of Artificial Sequence: Synthetic oligonucleotide

SEQ ID NO: 423273 - DNA, 31 bp, Artificial Sequence; identical to SEQ ID NO: 74505
  Description of Artificial Sequence: Synthetic oligonucleotide

SEQ ID NO: 423274 - DNA, 30 bp, Artificial Sequence; identical to SEQ ID NO: 74506
  Description of Artificial Sequence: Synthetic oligonucleotide

SEQ ID NO: 423275 - DNA, 30 bp, Artificial Sequence; identical to SEQ ID NO: 74507
  Description of Artificial Sequence: Synthetic oligonucleotide

SEQ ID NO: 423276 - DNA, 29 bp, Artificial Sequence
  Description of Artificial Sequence: Synthetic oligonucleotide
gagtgtcatttcctcaatgggacggagcg

SEQ ID NO: 423277 - DNA, 30 bp, Artificial Sequence; identical to SEQ ID NO: 74509
  Description of Artificial Sequence: Synthetic oligonucleotide

SEQ ID NO: 423278 - DNA, 29 bp, Artificial Sequence
  Description of Artificial Sequence: Synthetic oligonucleotide
gtgtcatttcctcaatgggacggagcgag

SEQ ID NO: 423279 - DNA, 30 bp, Artificial Sequence; identical to SEQ ID NO: 74511
  Description of Artificial Sequence: Synthetic oligonucleotide

SEQ ID NO: 423280 - DNA, 29 bp, Artificial Sequence
  Description of Artificial Sequence: Synthetic oligonucleotide
gtcatttcctcaatgggacggagcgagtg

SEQ ID NO: 423281 - DNA, 30 bp, Artificial Sequence; identical to SEQ ID NO: 74513
  Description of Artificial Sequence: Synthetic oligonucleotide

SEQ ID NO: 423282 - DNA, 29 bp, Artificial Sequence
  Description of Artificial Sequence: Synthetic oligonucleotide
catttcctcaatgggacggagcgagtgtg

SEQ ID NO: 423283 - DNA, 29 bp, Artificial Sequence
  Description of Artificial Sequence: Synthetic oligonucleotide
atttcctcaatgggacggagcgagtgtgg

SEQ ID NO: 423284 - DNA, 28 bp, Artificial Sequence
  Description of Artificial Sequence: Synthetic oligonucleotide
tttcctcaatgggacggagcgagtgtgg

SEQ ID NO: 423285 - DNA, 27 bp, Artificial Sequence
  Description of Artificial Sequence: Synthetic oligonucleotide
ttcctcaatgggacggagcgagtgtgg

SEQ ID NO: 423286 - DNA, 27 bp, Artificial Sequence
  Description of Artificial Sequence: Synthetic oligonucleotide
tcctcaatgggacggagcgagtgtgga

SEQ ID NO: 423287 - DNA, 27 bp, Artificial Sequence
  Description of Artificial Sequence: Synthetic oligonucleotide
cctcaatgggacggagcgagtgtggaa

SEQ ID NO: 423288 - DNA, 27 bp, Artificial Sequence
  Description of Artificial Sequence: Synthetic oligonucleotide
ctcaatgggacggagcgagtgtggaac

SEQ ID NO: 423289 - DNA, 27 bp, Artificial Sequence
  Description of Artificial Sequence: Synthetic oligonucleotide
tcaatgggacggagcgagtgtggaacc

SEQ ID NO: 423290 - DNA, 27 bp, Artificial Sequence
  Description of Artificial Sequence: Synthetic oligonucleotide
caatgggacggagcgagtgtggaacct

SEQ ID NO: 423291 - DNA, 27 bp, Artificial Sequence
  Description of Artificial Sequence: Synthetic oligonucleotide
aatgggacggagcgagtgtggaacctg

SEQ ID NO: 423292 - DNA, 27 bp, Artificial Sequence
  Description of Artificial Sequence: Synthetic oligonucleotide
atgggacggagcgagtgtggaacctga

SEQ ID NO: 423293 - DNA, 27 bp, Artificial Sequence
  Description of Artificial Sequence: Synthetic oligonucleotide
tgggacggagcgagtgtggaacctgat

SEQ ID NO: 423294 - DNA, 26 bp, Artificial Sequence
  Description of Artificial Sequence: Synthetic oligonucleotide
gggacggagcgagtgtggaacctgat

SEQ ID NO: 423295 - DNA, 27 bp, Artificial Sequence
  Description of Artificial Sequence: Synthetic oligonucleotide
ggacggagcgagtgtggaacctgatca

SEQ ID NO: 423296 - DNA, 27 bp, Artificial Sequence
  Description of Artificial Sequence: Synthetic oligonucleotide
gacggagcgagtgtggaacctgatcag

SEQ ID NO: 423297 - DNA, 30 bp, Artificial Sequence; identical to SEQ ID NO: 74529
  Description of Artificial Sequence: Synthetic oligonucleotide

SEQ ID NO: 423298 - DNA, 29 bp, Artificial Sequence
  Description of Artificial Sequence: Synthetic oligonucleotide
cggagcgagtgtggaacctgatcagatac

SEQ ID NO: 423299 - DNA, 31 bp, Artificial Sequence; identical to SEQ ID NO: 74531
  Description of Artificial Sequence: Synthetic oligonucleotide

SEQ ID NO: 423300 - DNA, 36 bp, Artificial Sequence; identical to SEQ ID NO: 74532
  Description of Artificial Sequence: Synthetic oligonucleotide

SEQ ID NO: 423301 - DNA, 36 bp, Artificial Sequence; identical to SEQ ID NO: 74533
  Description of Artificial Sequence: Synthetic oligonucleotide

SEQ ID NO: 423302 - DNA, 35 bp, Artificial Sequence; identical to SEQ ID NO: 74534
  Description of Artificial Sequence: Synthetic oligonucleotide

SEQ ID NO: 423303 - DNA, 37 bp, Artificial Sequence; identical to SEQ ID NO: 74535
  Description of Artificial Sequence: Synthetic oligonucleotide

SEQ ID NO: 423304 - DNA, 38 bp, Artificial Sequence; identical to SEQ ID NO: 74536
  Description of Artificial Sequence: Synthetic oligonucleotide

SEQ ID NO: 423305 - DNA, 38 bp, Artificial Sequence; identical to SEQ ID NO: 74537
  Description of Artificial Sequence: Synthetic oligonucleotide

SEQ ID NO: 423306 - DNA, 37 bp, Artificial Sequence; identical to SEQ ID NO: 74538
  Description of Artificial Sequence: Synthetic oligonucleotide

SEQ ID NO: 423307 - DNA, 38 bp, Artificial Sequence; identical to SEQ ID NO: 74539
  Description of Artificial Sequence: Synthetic oligonucleotide

SEQ ID NO: 423308 - DNA, 37 bp, Artificial Sequence; identical to SEQ ID NO: 74540
  Description of Artificial Sequence: Synthetic oligonucleotide

SEQ ID NO: 423309 - DNA, 39 bp, Artificial Sequence; identical to SEQ ID NO: 74541
  Description of Artificial Sequence: Synthetic oligonucleotide

SEQ ID NO: 423310 - DNA, 38 bp, Artificial Sequence; identical to SEQ ID NO: 74542
  Description of Artificial Sequence: Synthetic oligonucleotide

SEQ ID NO: 423311 - DNA, 38 bp, Artificial Sequence; identical to SEQ ID NO: 74543
  Description of Artificial Sequence: Synthetic oligonucleotide

SEQ ID NO: 423312 - DNA, 38 bp, Artificial Sequence; identical to SEQ ID NO: 74544
  Description of Artificial Sequence: Synthetic oligonucleotide

SEQ ID NO: 423313 - DNA, 37 bp, Artificial Sequence; identical to SEQ ID NO: 74545
  Description of Artificial Sequence: Synthetic oligonucleotide

SEQ ID NO: 423314 - DNA, 36 bp, Artificial Sequence; identical to SEQ ID NO: 74546
  Description of Artificial Sequence: Synthetic oligonucleotide

SEQ ID NO: 423315 - DNA, 36 bp, Artificial Sequence; identical to SEQ ID NO: 74547
  Description of Artificial Sequence: Synthetic oligonucleotide

SEQ ID NO: 423316 - DNA, 36 bp, Artificial Sequence; identical to SEQ ID NO: 74548
  Description of Artificial Sequence: Synthetic oligonucleotide

SEQ ID NO: 423317 - DNA, 35 bp, Artificial Sequence; identical to SEQ ID NO: 74549
  Description of Artificial Sequence: Synthetic oligonucleotide

SEQ ID NO: 423318 - DNA, 35 bp, Artificial Sequence; identical to SEQ ID NO: 74550
  Description of Artificial Sequence: Synthetic oligonucleotide

SEQ ID NO: 423319 - DNA, 34 bp, Artificial Sequence; identical to SEQ ID NO: 74551
  Description of Artificial Sequence: Synthetic oligonucleotide

SEQ ID NO: 423320 - DNA, 33 bp, Artificial Sequence; identical to SEQ ID NO: 74552
  Description of Artificial Sequence: Synthetic oligonucleotide

SEQ ID NO: 423321 - DNA, 33 bp, Artificial Sequence; identical to SEQ ID NO: 74553
  Description of Artificial Sequence: Synthetic oligonucleotide

SEQ ID NO: 423322 - DNA, 32 bp, Artificial Sequence; identical to SEQ ID NO: 74554
  Description of Artificial Sequence: Synthetic oligonucleotide

SEQ ID NO: 423323 - DNA, 34 bp, Artificial Sequence; identical to SEQ ID NO: 74555
  Description of Artificial Sequence: Synthetic oligonucleotide

SEQ ID NO: 423324 - DNA, 33 bp, Artificial Sequence; identical to SEQ ID NO: 74556
  Description of Artificial Sequence: Synthetic oligonucleotide

SEQ ID NO: 423325 - DNA, 32 bp, Artificial Sequence; identical to SEQ ID NO: 74557
  Description of Artificial Sequence: Synthetic oligonucleotide

SEQ ID NO: 423326 - DNA, 31 bp, Artificial Sequence; identical to SEQ ID NO: 74558
  Description of Artificial Sequence: Synthetic oligonucleotide

SEQ ID NO: 423327 - DNA, 33 bp, Artificial Sequence; identical to SEQ ID NO: 74559
  Description of Artificial Sequence: Synthetic oligonucleotide

SEQ ID NO: 423328 - DNA, 32 bp, Artificial Sequence; identical to SEQ ID NO: 74560
  Description of Artificial Sequence: Synthetic oligonucleotide

SEQ ID NO: 423329 - DNA, 31 bp, Artificial Sequence; identical to SEQ ID NO: 74561
  Description of Artificial Sequence: Synthetic oligonucleotide

SEQ ID NO: 423330 - DNA, 32 bp, Artificial Sequence; identical to SEQ ID NO: 74562
  Description of Artificial Sequence: Synthetic oligonucleotide

SEQ ID NO: 423331 - DNA, 31 bp, Artificial Sequence; identical to SEQ ID NO: 74563
  Description of Artificial Sequence: Synthetic oligonucleotide

SEQ ID NO: 423332 - DNA, 30 bp, Artificial Sequence; identical to SEQ ID NO: 74564
  Description of Artificial Sequence: Synthetic oligonucleotide

SEQ ID NO: 423333 - DNA, 29 bp, Artificial Sequence
  Description of Artificial Sequence: Synthetic oligonucleotide
aaccaagaggagtacgcgcgctacaacag

SEQ ID NO: 423334 - DNA, 28 bp, Artificial Sequence
  Description of Artificial Sequence: Synthetic oligonucleotide
accaagaggagtacgcgcgctacaacag

SEQ ID NO: 423335 - DNA, 27 bp, Artificial Sequence
  Description of Artificial Sequence: Synthetic oligonucleotide
ccaagaggagtacgcgcgctacaacag

SEQ ID NO: 423336 - DNA, 28 bp, Artificial Sequence
  Description of Artificial Sequence: Synthetic oligonucleotide
caagaggagtacgcgcgctacaacagtg

SEQ ID NO: 423337 - DNA, 29 bp, Artificial Sequence
  Description of Artificial Sequence: Synthetic oligonucleotide
aagaggagtacgcgcgctacaacagtgac

SEQ ID NO: 423338 - DNA, 28 bp, Artificial Sequence
  Description of Artificial Sequence: Synthetic oligonucleotide
agaggagtacgcgcgctacaacagtgac

SEQ ID NO: 423339 - DNA, 27 bp, Artificial Sequence
  Description of Artificial Sequence: Synthetic oligonucleotide
gaggagtacgcgcgctacaacagtgac

SEQ ID NO: 423340 - DNA, 27 bp, Artificial Sequence
  Description of Artificial Sequence: Synthetic oligonucleotide
aggagtacgcgcgctacaacagtgacc

SEQ ID NO: 423341 - DNA, 27 bp, Artificial Sequence
  Description of Artificial Sequence: Synthetic oligonucleotide
ggagtacgcgcgctacaacagtgacct

SEQ ID NO: 423342 - DNA, 27 bp, Artificial Sequence
  Description of Artificial Sequence: Synthetic oligonucleotide
gagtacgcgcgctacaacagtgacctg

SEQ ID NO: 423343 - DNA, 27 bp, Artificial Sequence
  Description of Artificial Sequence: Synthetic oligonucleotide
agtacgcgcgctacaacagtgacctgg

SEQ ID NO: 423344 - DNA, 26 bp, Artificial Sequence
  Description of Artificial Sequence: Synthetic oligonucleotide
gtacgcgcgctacaacagtgacctgg

SEQ ID NO: 423345 - DNA, 26 bp, Artificial Sequence
  Description of Artificial Sequence: Synthetic oligonucleotide
tacgcgcgctacaacagtgacctggg

SEQ ID NO: 423346 - DNA, 25 bp, Artificial Sequence
  Description of Artificial Sequence: Synthetic oligonucleotide
acgcgcgctacaacagtgacctggg

SEQ ID NO: 423347 - DNA, 24 bp, Artificial Sequence
  Description of Artificial Sequence: Synthetic oligonucleotide
cgcgcgctacaacagtgacctggg

SEQ ID NO: 423348 - DNA, 24 bp, Artificial Sequence
  Description of Artificial Sequence: Synthetic oligonucleotide
gcgcgctacaacagtgacctgggg

SEQ ID NO: 423349 - DNA, 25 bp, Artificial Sequence
  Description of Artificial Sequence: Synthetic oligonucleotide
cgcgctacaacagtgacctggggga

SEQ ID NO: 423350 - DNA, 27 bp, Artificial Sequence
  Description of Artificial Sequence: Synthetic oligonucleotide
gcgctacaacagtgacctgggggagta

SEQ ID NO: 423351 - DNA, 27 bp, Artificial Sequence
  Description of Artificial Sequence: Synthetic oligonucleotide
cgctacaacagtgacctgggggagtac

SEQ ID NO: 423352 - DNA, 27 bp, Artificial Sequence
  Description of Artificial Sequence: Synthetic oligonucleotide
gctacaacagtgacctgggggagtacc

SEQ ID NO: 423353 - DNA, 28 bp, Artificial Sequence
  Description of Artificial Sequence: Synthetic oligonucleotide
ctacaacagtgacctgggggagtaccag

SEQ ID NO: 423354 - DNA, 28 bp, Artificial Sequence
  Description of Artificial Sequence: Synthetic oligonucleotide
tacaacagtgacctgggggagtaccagg

SEQ ID NO: 423355 - DNA, 27 bp, Artificial Sequence
  Description of Artificial Sequence: Synthetic oligonucleotide
acaacagtgacctgggggagtaccagg

SEQ ID NO: 423356 - DNA, 26 bp, Artificial Sequence
  Description of Artificial Sequence: Synthetic oligonucleotide
caacagtgacctgggggagtaccagg

SEQ ID NO: 423357 - DNA, 26 bp, Artificial Sequence
  Description of Artificial Sequence: Synthetic oligonucleotide
aacagtgacctgggggagtaccaggc

SEQ ID NO: 423358 - DNA, 25 bp, Artificial Sequence
  Description of Artificial Sequence: Synthetic oligonucleotide
acagtgacctgggggagtaccaggc

SEQ ID NO: 423359 - DNA, 24 bp, Artificial Sequence
  Description of Artificial Sequence: Synthetic oligonucleotide
cagtgacctgggggagtaccaggc

SEQ ID NO: 423360 - DNA, 24 bp, Artificial Sequence
  Description of Artificial Sequence: Synthetic oligonucleotide
agtgacctgggggagtaccaggcg

SEQ ID NO: 423361 - DNA, 23 bp, Artificial Sequence
  Description of Artificial Sequence: Synthetic oligonucleotide
gtgacctgggggagtaccaggcg

SEQ ID NO: 423362 - DNA, 24 bp, Artificial Sequence
  Description of Artificial Sequence: Synthetic oligonucleotide
tgacctgggggagtaccaggcggt

SEQ ID NO: 423363 - DNA, 23 bp, Artificial Sequence
  Description of Artificial Sequence: Synthetic oligonucleotide
gacctgggggagtaccaggcggt

SEQ ID NO: 423364 - DNA, 24 bp, Artificial Sequence
  Description of Artificial Sequence: Synthetic oligonucleotide
acctgggggagtaccaggcggtga

SEQ ID NO: 423365 - DNA, 23 bp, Artificial Sequence
  Description of Artificial Sequence: Synthetic oligonucleotide
cctgggggagtaccaggcggtga

SEQ ID NO: 423366 - DNA, 23 bp, Artificial Sequence
  Description of Artificial Sequence: Synthetic oligonucleotide
ctgggggagtaccaggcggtgac

SEQ ID NO: 423367 - DNA, 27 bp, Artificial Sequence
  Description of Artificial Sequence: Synthetic oligonucleotide
cggcgagtccaacctaaggtgactgtg

SEQ ID NO: 423368 - DNA, 30 bp, Artificial Sequence; identical to SEQ ID NO: 74600
  Description of Artificial Sequence: Synthetic oligonucleotide

SEQ ID NO: 423369 - DNA, 30 bp, Artificial Sequence; identical to SEQ ID NO: 74601
  Description of Artificial Sequence: Synthetic oligonucleotide

SEQ ID NO: 423370 - DNA, 32 bp, Artificial Sequence; identical to SEQ ID NO: 74602
  Description of Artificial Sequence: Synthetic oligonucleotide

SEQ ID NO: 423371 - DNA, 35 bp, Artificial Sequence; identical to SEQ ID NO: 74603
  Description of Artificial Sequence: Synthetic oligonucleotide

SEQ ID NO: 423372 - DNA, 36 bp, Artificial Sequence; identical to SEQ ID NO: 74604
  Description of Artificial Sequence: Synthetic oligonucleotide

SEQ ID NO: 423373 - DNA, 35 bp, Artificial Sequence; identical to SEQ ID NO: 74605
  Description of Artificial Sequence: Synthetic oligonucleotide

SEQ ID NO: 423374 - DNA, 35 bp, Artificial Sequence; identical to SEQ ID NO: 74606
  Description of Artificial Sequence: Synthetic oligonucleotide

SEQ ID NO: 423375 - DNA, 34 bp, Artificial Sequence; identical to SEQ ID NO: 74607
  Description of Artificial Sequence: Synthetic oligonucleotide

SEQ ID NO: 423376 - DNA, 30 bp, Artificial Sequence; identical to SEQ ID NO: 74608
  Description of Artificial Sequence: Synthetic oligonucleotide

SEQ ID NO: 423377 - DNA, 30 bp, Artificial Sequence; identical to SEQ ID NO: 74609
  Description of Artificial Sequence: Synthetic oligonucleotide

SEQ ID NO: 423378 - DNA, 29 bp, Artificial Sequence
  Description of Artificial Sequence: Synthetic oligonucleotide
gcattgaagtcaggtggttccggaacagc

SEQ ID NO: 423379 - DNA, 29 bp, Artificial Sequence
  Description of Artificial Sequence: Synthetic oligonucleotide
cattgaagtcaggtggttccggaacagcc

SEQ ID NO: 423380 - DNA, 30 bp, Artificial Sequence; identical to SEQ ID NO: 74612
  Description of Artificial Sequence: Synthetic oligonucleotide

SEQ ID NO: 423381 - DNA, 29 bp, Artificial Sequence
  Description of Artificial Sequence: Synthetic oligonucleotide
ttgaagtcaggtggttccggaacagccag

SEQ ID NO: 423382 - DNA, 28 bp, Artificial Sequence
  Description of Artificial Sequence: Synthetic oligonucleotide
tgaagtcaggtggttccggaacagccag

SEQ ID NO: 423383 - DNA, 27 bp, Artificial Sequence
  Description of Artificial Sequence: Synthetic oligonucleotide
gaagtcaggtggttccggaacagccag

SEQ ID NO: 423384 - DNA, 27 bp, Artificial Sequence
  Description of Artificial Sequence: Synthetic oligonucleotide
aagtcaggtggttccggaacagccagg

SEQ ID NO: 423385 - DNA, 27 bp, Artificial Sequence
  Description of Artificial Sequence: Synthetic oligonucleotide
agtcaggtggttccggaacagccagga

SEQ ID NO: 423386 - DNA, 27 bp, Artificial Sequence
  Description of Artificial Sequence: Synthetic oligonucleotide
gtcaggtggttccggaacagccaggaa

SEQ ID NO: 423387 - DNA, 27 bp, Artificial Sequence
  Description of Artificial Sequence: Synthetic oligonucleotide
tcaggtggttccggaacagccaggaag

SEQ ID NO: 423388 - DNA, 27 bp, Artificial Sequence
  Description of Artificial Sequence: Synthetic oligonucleotide
caggtggttccggaacagccaggaaga

SEQ ID NO: 423389 - DNA, 27 bp, Artificial Sequence
  Description of Artificial Sequence: Synthetic oligonucleotide
aggtggttccggaacagccaggaagag

SEQ ID NO: 423390 - DNA, 27 bp, Artificial Sequence
  Description of Artificial Sequence: Synthetic oligonucleotide
ggtggttccggaacagccaggaagaga

SEQ ID NO: 423391 - DNA, 28 bp, Artificial Sequence
  Description of Artificial Sequence: Synthetic oligonucleotide
gtggttccggaacagccaggaagagaag

SEQ ID NO: 423392 - DNA, 28 bp, Artificial Sequence
  Description of Artificial Sequence: Synthetic oligonucleotide
tggttccggaacagccaggaagagaagg

SEQ ID NO: 423393 - DNA, 27 bp, Artificial Sequence
  Description of Artificial Sequence: Synthetic oligonucleotide
ggttccggaacagccaggaagagaagg

SEQ ID NO: 423394 - DNA, 27 bp, Artificial Sequence
  Description of Artificial Sequence: Synthetic oligonucleotide
gttccggaacagccaggaagagaaggc

SEQ ID NO: 423395 - DNA, 28 bp, Artificial Sequence
  Description of Artificial Sequence: Synthetic oligonucleotide
ttccggaacagccaggaagagaaggctg

SEQ ID NO: 423396 - DNA, 27 bp, Artificial Sequence
  Description of Artificial Sequence: Synthetic oligonucleotide
tccggaacagccaggaagagaaggctg

SEQ ID NO: 423397 - DNA, 26 bp, Artificial Sequence
  Description of Artificial Sequence: Synthetic oligonucleotide
ccggaacagccaggaagagaaggctg

SEQ ID NO: 423398 - DNA, 26 bp, Artificial Sequence
  Description of Artificial Sequence: Synthetic oligonucleotide
cggaacagccaggaagagaaggctgg

SEQ ID NO: 423399 - DNA, 26 bp, Artificial Sequence
  Description of Artificial Sequence: Synthetic oligonucleotide
ggaacagccaggaagagaaggctggg

SEQ ID NO: 423400 - DNA, 27 bp, Artificial Sequence
  Description of Artificial Sequence: Synthetic oligonucleotide
gaacagccaggaagagaaggctggggt

SEQ ID NO: 423401 - DNA, 27 bp, Artificial Sequence
  Description of Artificial Sequence: Synthetic oligonucleotide
aacagccaggaagagaaggctggggtg

SEQ ID NO: 423402 - DNA, 26 bp, Artificial Sequence
  Description of Artificial Sequence: Synthetic oligonucleotide
acagccaggaagagaaggctggggtg

SEQ ID NO: 423403 - DNA, 25 bp, Artificial Sequence
  Description of Artificial Sequence: Synthetic oligonucleotide
cagccaggaagagaaggctggggtg

SEQ ID NO: 423404 - DNA, 26 bp, Artificial Sequence
  Description of Artificial Sequence: Synthetic oligonucleotide
agccaggaagagaaggctggggtggt

SEQ ID NO: 423405 - DNA, 30 bp, Artificial Sequence; identical to SEQ ID NO: 74637
  Description of Artificial Sequence: Synthetic oligonucleotide

SEQ ID NO: 423406 - DNA, 30 bp, Artificial Sequence; identical to SEQ ID NO: 74638
  Description of Artificial Sequence: Synthetic oligonucleotide

SEQ ID NO: 423407 - DNA, 29 bp, Artificial Sequence
  Description of Artificial Sequence: Synthetic oligonucleotide
gaggtttacacctgccaagtggagcatcc

SEQ ID NO: 423408 - DNA, 31 bp, Artificial Sequence; identical to SEQ ID NO: 74640
  Description of Artificial Sequence: Synthetic oligonucleotide

SEQ ID NO: 423409 - DNA, 30 bp, Artificial Sequence; identical to SEQ ID NO: 74641
  Description of Artificial Sequence: Synthetic oligonucleotide

SEQ ID NO: 423410 - DNA, 30 bp, Artificial Sequence; identical to SEQ ID NO: 74642
  Description of Artificial Sequence: Synthetic oligonucleotide

SEQ ID NO: 423411 - DNA, 32 bp, Artificial Sequence; identical to SEQ ID NO: 74643
  Description of Artificial Sequence: Synthetic oligonucleotide

SEQ ID NO: 423412 - DNA, 31 bp, Artificial Sequence; identical to SEQ ID NO: 74644
  Description of Artificial Sequence: Synthetic oligonucleotide

SEQ ID NO: 423413 - DNA, 30 bp, Artificial Sequence; identical to SEQ ID NO: 74645
  Description of Artificial Sequence: Synthetic oligonucleotide

SEQ ID NO: 423414 - DNA, 29 bp, Artificial Sequence
  Description of Artificial Sequence: Synthetic oligonucleotide
acacctgccaagtggagcatccaagcatg

SEQ ID NO: 423415 - DNA, 28 bp, Artificial Sequence
  Description of Artificial Sequence: Synthetic oligonucleotide
cacctgccaagtggagcatccaagcatg

SEQ ID NO: 423416 - DNA, 30 bp, Artificial Sequence; identical to SEQ ID NO: 74648
  Description of Artificial Sequence: Synthetic oligonucleotide

SEQ ID NO: 423417 - DNA, 29 bp, Artificial Sequence
  Description of Artificial Sequence: Synthetic oligonucleotide
cctgccaagtggagcatccaagcatgatg

SEQ ID NO: 423418 - DNA, 30 bp, Artificial Sequence; identical to SEQ ID NO: 74650
  Description of Artificial Sequence: Synthetic oligonucleotide

SEQ ID NO: 423419 - DNA, 30 bp, Artificial Sequence; identical to SEQ ID NO: 74651
  Description of Artificial Sequence: Synthetic oligonucleotide

SEQ ID NO: 423420 - DNA, 29 bp, Artificial Sequence
  Description of Artificial Sequence: Synthetic oligonucleotide
gccaagtggagcatccaagcatgatgagc

SEQ ID NO: 423421 - DNA, 29 bp, Artificial Sequence
  Description of Artificial Sequence: Synthetic oligonucleotide
ccaagtggagcatccaagcatgatgagcc

SEQ ID NO: 423422 - DNA, 29 bp, Artificial Sequence
  Description of Artificial Sequence: Synthetic oligonucleotide
caagtggagcatccaagcatgatgagccc

SEQ ID NO: 423423 - DNA, 30 bp, Artificial Sequence; identical to SEQ ID NO: 74655
  Description of Artificial Sequence: Synthetic oligonucleotide

SEQ ID NO: 423424 - DNA, 29 bp, Artificial Sequence
  Description of Artificial Sequence: Synthetic oligonucleotide
agtggagcatccaagcatgatgagccctc

SEQ ID NO: 423425 - DNA, 28 bp, Artificial Sequence
  Description of Artificial Sequence: Synthetic oligonucleotide
gtggagcatccaagcatgatgagccctc

SEQ ID NO: 423426 - DNA, 29 bp, Artificial Sequence
  Description of Artificial Sequence: Synthetic oligonucleotide
tggagcatccaagcatgatgagccctctc

SEQ ID NO: 423427 - DNA, 28 bp, Artificial Sequence
  Description of Artificial Sequence: Synthetic oligonucleotide
ggagcatccaagcatgatgagccctctc

SEQ ID NO: 423428 - DNA, 29 bp, Artificial Sequence
  Description of Artificial Sequence: Synthetic oligonucleotide
gagcatccaagcatgatgagccctctcac

SEQ ID NO: 423429 - DNA, 29 bp, Artificial Sequence
  Description of Artificial Sequence: Synthetic oligonucleotide
agcatccaagcatgatgagccctctcacg

SEQ ID NO: 423430 - DNA, 28 bp, Artificial Sequence
  Description of Artificial Sequence: Synthetic oligonucleotide
gcatccaagcatgatgagccctctcacg

SEQ ID NO: 423431 - DNA, 28 bp, Artificial Sequence
  Description of Artificial Sequence: Synthetic oligonucleotide
catccaagcatgatgagccctctcacgg

SEQ ID NO: 423432 - DNA, 29 bp, Artificial Sequence
  Description of Artificial Sequence: Synthetic oligonucleotide
atccaagcatgatgagccctctcacggtg

SEQ ID NO: 423433 - DNA, 28 bp, Artificial Sequence
  Description of Artificial Sequence: Synthetic oligonucleotide
tccaagcatgatgagccctctcacggtg

SEQ ID NO: 423434 - DNA, 27 bp, Artificial Sequence
  Description of Artificial Sequence: Synthetic oligonucleotide
ccaagcatgatgagccctctcacggtg

SEQ ID NO: 423435 - DNA, 27 bp, Artificial Sequence
  Description of Artificial Sequence: Synthetic oligonucleotide
caagcatgatgagccctctcacggtgc

SEQ ID NO: 423436 - DNA, 30 bp, Artificial Sequence; identical to SEQ ID NO: 74668
  Description of Artificial Sequence: Synthetic oligonucleotide

SEQ ID NO: 423437 - DNA, 29 bp, Artificial Sequence
  Description of Artificial Sequence: Synthetic oligonucleotide
agcatgatgagccctctcacggtgcaatg

SEQ ID NO: 423438 - DNA, 28 bp, Artificial Sequence
  Description of Artificial Sequence: Synthetic oligonucleotide
gcatgatgagccctctcacggtgcaatg

SEQ ID NO: 423439 - DNA, 28 bp, Artificial Sequence
  Description of Artificial Sequence: Synthetic oligonucleotide
catgatgagccctctcacggtgcaatgg

SEQ ID NO: 423440 - DNA, 29 bp, Artificial Sequence
  Description of Artificial Sequence: Synthetic oligonucleotide
atgatgagccctctcacggtgcaatggag

SEQ ID NO: 423441 - DNA, 28 bp, Artificial Sequence
  Description of Artificial Sequence: Synthetic oligonucleotide
tgatgagccctctcacggtgcaatggag

SEQ ID NO: 423442 - DNA, 27 bp, Artificial Sequence
  Description of Artificial Sequence: Synthetic oligonucleotide
gatgagccctctcacggtgcaatggag

SEQ ID NO: 423443 - DNA, 28 bp, Artificial Sequence
  Description of Artificial Sequence: Synthetic oligonucleotide
atgagccctctcacggtgcaatggagtg

SEQ ID NO: 423444 - DNA, 27 bp, Artificial Sequence
  Description of Artificial Sequence: Synthetic oligonucleotide
tgagccctctcacggtgcaatggagtg

SEQ ID NO: 423445 - DNA, 26 bp, Artificial Sequence
  Description of Artificial Sequence: Synthetic oligonucleotide
gagccctctcacggtgcaatggagtg

SEQ ID NO: 423446 - DNA, 27 bp, Artificial Sequence
  Description of Artificial Sequence: Synthetic oligonucleotide
agccctctcacggtgcaatggagtgca

SEQ ID NO: 423447 - DNA, 26 bp, Artificial Sequence
  Description of Artificial Sequence: Synthetic oligonucleotide
gccctctcacggtgcaatggagtgca

SEQ ID NO: 423448 - DNA, 26 bp, Artificial Sequence
  Description of Artificial Sequence: Synthetic oligonucleotide
ccctctcacggtgcaatggagtgcac

SEQ ID NO: 423449 - DNA, 26 bp, Artificial Sequence
  Description of Artificial Sequence: Synthetic oligonucleotide
cctctcacggtgcaatggagtgcacg

SEQ ID NO: 423450 - DNA, 27 bp, Artificial Sequence
  Description of Artificial Sequence: Synthetic oligonucleotide
ctctcacggtgcaatggagtgcacggt

SEQ ID NO: 423451 - DNA, 27 bp, Artificial Sequence
  Description of Artificial Sequence: Synthetic oligonucleotide
tctcacggtgcaatggagtgcacggtc

SEQ ID NO: 423452 - DNA, 27 bp, Artificial Sequence
  Description of Artificial Sequence: Synthetic oligonucleotide
ctcacggtgcaatggagtgcacggtct

SEQ ID NO: 423453 - DNA, 27 bp, Artificial Sequence
  Description of Artificial Sequence: Synthetic oligonucleotide
tcacggtgcaatggagtgcacggtctg

SEQ ID NO: 423454 - DNA, 27 bp, Artificial Sequence
  Description of Artificial Sequence: Synthetic oligonucleotide
cacggtgcaatggagtgcacggtctga

SEQ ID NO: 423455 - DNA, 29 bp, Artificial Sequence
  Description of Artificial Sequence: Synthetic oligonucleotide
acggtgcaatggagtgcacggtctgaatc

SEQ ID NO: 423456 - DNA, 28 bp, Artificial Sequence
  Description of Artificial Sequence: Synthetic oligonucleotide
cggtgcaatggagtgcacggtctgaatc

SEQ ID NO: 423457 - DNA, 29 bp, Artificial Sequence
  Description of Artificial Sequence: Synthetic oligonucleotide
ggtgcaatggagtgcacggtctgaatctg

SEQ ID NO: 423458 - DNA, 29 bp, Artificial Sequence
  Description of Artificial Sequence: Synthetic oligonucleotide
gtgcaatggagtgcacggtctgaatctgc

SEQ ID NO: 423459 - DNA, 30 bp, Artificial Sequence; identical to SEQ ID NO: 74691
  Description of Artificial Sequence: Synthetic oligonucleotide

SEQ ID NO: 423460 - DNA, 29 bp, Artificial Sequence
  Description of Artificial Sequence: Synthetic oligonucleotide
gcaatggagtgcacggtctgaatctgcac

SEQ ID NO: 423461 - DNA, 30 bp, Artificial Sequence; identical to SEQ ID NO: 74693
  Description of Artificial Sequence: Synthetic oligonucleotide

SEQ ID NO: 423462 - DNA, 27 bp, Artificial Sequence
  Description of Artificial Sequence: Synthetic oligonucleotide
ttgtgctgggcctgctcttccttggga

SEQ ID NO: 423463 - DNA, 26 bp, Artificial Sequence
  Description of Artificial Sequence: Synthetic oligonucleotide
tgtgctgggcctgctcttccttggga

SEQ ID NO: 423464 - DNA, 25 bp, Artificial Sequence
  Description of Artificial Sequence: Synthetic oligonucleotide
gtgctgggcctgctcttccttggga

SEQ ID NO: 423465 - DNA, 26 bp, Artificial Sequence
  Description of Artificial Sequence: Synthetic oligonucleotide
tgctgggcctgctcttccttgggaca

SEQ ID NO: 423466 - DNA, 25 bp, Artificial Sequence
  Description of Artificial Sequence: Synthetic oligonucleotide
gctgggcctgctcttccttgggaca

SEQ ID NO: 423467 - DNA, 25 bp, Artificial Sequence
  Description of Artificial Sequence: Synthetic oligonucleotide
ctgggcctgctcttccttgggacag

SEQ ID NO: 423468 - DNA, 25 bp, Artificial Sequence
  Description of Artificial Sequence: Synthetic oligonucleotide
tgggcctgctcttccttgggacagg

SEQ ID NO: 423469 - DNA, 24 bp, Artificial Sequence
  Description of Artificial Sequence: Synthetic oligonucleotide
gggcctgctcttccttgggacagg

SEQ ID NO: 423470 - DNA, 24 bp, Artificial Sequence
  Description of Artificial Sequence: Synthetic oligonucleotide
ggcctgctcttccttgggacaggg

SEQ ID NO: 423471 - DNA, 25 bp, Artificial Sequence
  Description of Artificial Sequence: Synthetic oligonucleotide
gcctgctcttccttgggacagggct

SEQ ID NO: 423472 - DNA, 27 bp, Artificial Sequence
  Description of Artificial Sequence: Synthetic oligonucleotide
cctgctcttccttgggacagggctgtt

SEQ ID NO: 423473 - DNA, 27 bp, Artificial Sequence
  Description of Artificial Sequence: Synthetic oligonucleotide
ctgctcttccttgggacagggctgttc

SEQ ID NO: 423474 - DNA, 29 bp, Artificial Sequence
  Description of Artificial Sequence: Synthetic oligonucleotide
tgctcttccttgggacagggctgttcatc

SEQ ID NO: 423475 - DNA, 28 bp, Artificial Sequence
  Description of Artificial Sequence: Synthetic oligonucleotide
gctcttccttgggacagggctgttcatc

SEQ ID NO: 423476 - DNA, 30 bp, Artificial Sequence; identical to SEQ ID NO: 74708
  Description of Artificial Sequence: Synthetic oligonucleotide

SEQ ID NO: 423477 - DNA, 32 bp, Artificial Sequence; identical to SEQ ID NO: 74709
  Description of Artificial Sequence: Synthetic oligonucleotide

SEQ ID NO: 423478 - DNA, 31 bp, Artificial Sequence; identical to SEQ ID NO: 74710
  Description of Artificial Sequence: Synthetic oligonucleotide

SEQ ID NO: 423479 - DNA, 32 bp, Artificial Sequence; identical to SEQ ID NO: 74711
  Description of Artificial Sequence: Synthetic oligonucleotide

SEQ ID NO: 423480 - DNA, 31 bp, Artificial Sequence; identical to SEQ ID NO: 74712
  Description of Artificial Sequence: Synthetic oligonucleotide

SEQ ID NO: 423481 - DNA, 30 bp, Artificial Sequence; identical to SEQ ID NO: 74713
  Description of Artificial Sequence: Synthetic oligonucleotide

SEQ ID NO: 423482 - DNA, 30 bp, Artificial Sequence; identical to SEQ ID NO: 74714
  Description of Artificial Sequence: Synthetic oligonucleotide

SEQ ID NO: 423483 - DNA, 33 bp, Artificial Sequence; identical to SEQ ID NO: 74715
  Description of Artificial Sequence: Synthetic oligonucleotide

SEQ ID NO: 423484 - DNA, 32 bp, Artificial Sequence; identical to SEQ ID NO: 74716
  Description of Artificial Sequence: Synthetic oligonucleotide

SEQ ID NO: 423485 - DNA, 31 bp, Artificial Sequence; identical to SEQ ID NO: 74717
  Description of Artificial Sequence: Synthetic oligonucleotide

SEQ ID NO: 423486 - DNA, 32 bp, Artificial Sequence; identical to SEQ ID NO: 74718
  Description of Artificial Sequence: Synthetic oligonucleotide

SEQ ID NO: 423487 - DNA, 35 bp, Artificial Sequence; identical to SEQ ID NO: 74719
  Description of Artificial Sequence: Synthetic oligonucleotide

SEQ ID NO: 423488 - DNA, 35 bp, Artificial Sequence; identical to SEQ ID NO: 74720
  Description of Artificial Sequence: Synthetic oligonucleotide

SEQ ID NO: 423489 - DNA, 34 bp, Artificial Sequence; identical to SEQ ID NO: 74721
  Description of Artificial Sequence: Synthetic oligonucleotide

SEQ ID NO: 423490 - DNA, 35 bp, Artificial Sequence; identical to SEQ ID NO: 74722
  Description of Artificial Sequence: Synthetic oligonucleotide

SEQ ID NO: 423491 - DNA, 31 bp, Artificial Sequence; identical to SEQ ID NO: 74723
  Description of Artificial Sequence: Synthetic oligonucleotide

SEQ ID NO: 423492 - DNA, 30 bp, Artificial Sequence; identical to SEQ ID NO: 74724
  Description of Artificial Sequence: Synthetic oligonucleotide

SEQ ID NO: 423493 - DNA, 29 bp, Artificial Sequence
  Description of Artificial Sequence: Synthetic oligonucleotide
aggacactctggacttcagccaacaggac

SEQ ID NO: 423494 - DNA, 28 bp, Artificial Sequence
  Description of Artificial Sequence: Synthetic oligonucleotide
ggacactctggacttcagccaacaggac

SEQ ID NO: 423495 - DNA, 29 bp, Artificial Sequence
  Description of Artificial Sequence: Synthetic oligonucleotide
gacactctggacttcagccaacaggactc

SEQ ID NO: 423496 - DNA, 31 bp, Artificial Sequence; identical to SEQ ID NO: 74728
  Description of Artificial Sequence: Synthetic oligonucleotide

SEQ ID NO: 423497 - DNA, 30 bp, Artificial Sequence; identical to SEQ ID NO: 74729
  Description of Artificial Sequence: Synthetic oligonucleotide

SEQ ID NO: 423498 - DNA, 31 bp, Artificial Sequence; identical to SEQ ID NO: 74730
  Description of Artificial Sequence: Synthetic oligonucleotide

SEQ ID NO: 423499 - DNA, 30 bp, Artificial Sequence; identical to SEQ ID NO: 74731
  Description of Artificial Sequence: Synthetic oligonucleotide

SEQ ID NO: 423500 - DNA, 30 bp, Artificial Sequence; identical to SEQ ID NO: 74732
  Description of Artificial Sequence: Synthetic oligonucleotide

SEQ ID NO: 423501 - DNA, 29 bp, Artificial Sequence
  Description of Artificial Sequence: Synthetic oligonucleotide
ctggacttcagccaacaggactcttgagc

SEQ ID NO: 423502 - DNA, 30 bp, Artificial Sequence; identical to SEQ ID NO: 74734
  Description of Artificial Sequence: Synthetic oligonucleotide

SEQ ID NO: 423503 - DNA, 29 bp, Artificial Sequence
  Description of Artificial Sequence: Synthetic oligonucleotide
ggacttcagccaacaggactcttgagctg

SEQ ID NO: 423504 - DNA, 20 bp, Artificial Sequence
  Description of Artificial Sequence: Synthetic oligonucleotide
cggaggcgggccgaggtggt

SEQ ID NO: 423505 - DNA, 20 bp, Artificial Sequence
  Description of Artificial Sequence: Synthetic oligonucleotide
ggaggcgggccgaggtgggt

SEQ ID NO: 423506 - DNA, 20 bp, Artificial Sequence
  Description of Artificial Sequence: Synthetic oligonucleotide
gaggcgggccgaggtgggca

SEQ ID NO: 423507 - DNA, 20 bp, Artificial Sequence
  Description of Artificial Sequence: Synthetic oligonucleotide
aggcgggccgaggtgggcac

SEQ ID NO: 423508 - DNA, 20 bp, Artificial Sequence
  Description of Artificial Sequence: Synthetic oligonucleotide
ggcgggccgaggtgggcact

SEQ ID NO: 423509 - DNA, 21 bp, Artificial Sequence
  Description of Artificial Sequence: Synthetic oligonucleotide
gcgggccgaggtgggcaccta

SEQ ID NO: 423510 - DNA, 22 bp, Artificial Sequence
  Description of Artificial Sequence: Synthetic oligonucleotide
cgggccgaggtgggcacctact

SEQ ID NO: 423511 - DNA, 22 bp, Artificial Sequence
  Description of Artificial Sequence: Synthetic oligonucleotide
gggccgaggtgggcacctactg

SEQ ID NO: 423512 - DNA, 23 bp, Artificial Sequence
  Description of Artificial Sequence: Synthetic oligonucleotide
ggccgaggtgggcacctactgca

SEQ ID NO: 423513 - DNA, 26 bp, Artificial Sequence
  Description of Artificial Sequence: Synthetic oligonucleotide
gccgaggtgggcacctactgcagata

SEQ ID NO: 423514 - DNA, 27 bp, Artificial Sequence
  Description of Artificial Sequence: Synthetic oligonucleotide
ccgaggtgggcacctactgcagataca

SEQ ID NO: 423515 - DNA, 28 bp, Artificial Sequence
  Description of Artificial Sequence: Synthetic oligonucleotide
cgaggtgggcacctactgcagatacaac

SEQ ID NO: 423516 - DNA, 30 bp, Artificial Sequence; identical to SEQ ID NO: 74748
  Description of Artificial Sequence: Synthetic oligonucleotide

SEQ ID NO: 423517 - DNA, 30 bp, Artificial Sequence; identical to SEQ ID NO: 74749
  Description of Artificial Sequence: Synthetic oligonucleotide

SEQ ID NO: 423518 - DNA, 29 bp, Artificial Sequence
  Description of Artificial Sequence: Synthetic oligonucleotide
ggtgggcacctactgcagatacaactacg

SEQ ID NO: 423519 - DNA, 29 bp, Artificial Sequence
  Description of Artificial Sequence: Synthetic oligonucleotide
gtgggcacctactgcagatacaactacgg

SEQ ID NO: 423520 - DNA, 29 bp, Artificial Sequence
  Description of Artificial Sequence: Synthetic oligonucleotide
tgggcacctactgcagatacaactacggg

SEQ ID NO: 423521 - DNA, 28 bp, Artificial Sequence
  Description of Artificial Sequence: Synthetic oligonucleotide
gggcacctactgcagatacaactacggg

SEQ ID NO: 423522 - DNA, 28 bp, Artificial Sequence
  Description of Artificial Sequence: Synthetic oligonucleotide
ggcacctactgcagatacaactacgggg

SEQ ID NO: 423523 - DNA, 30 bp, Artificial Sequence; identical to SEQ ID NO: 74755
  Description of Artificial Sequence: Synthetic oligonucleotide

SEQ ID NO: 423524 - DNA, 33 bp, Artificial Sequence
  Description of Artificial Sequence: Synthetic oligonucleotide
tgaccagcaactgatgatgctagtgaactcagg

SEQ ID NO: 423525 - DNA, 32 bp, Artificial Sequence
  Description of Artificial Sequence: Synthetic oligonucleotide
gaccagcaactgatgatgctagtgaactcagg

SEQ ID NO: 423526 - DNA, 33 bp, Artificial Sequence
  Description of Artificial Sequence: Synthetic oligonucleotide
accagcaactgatgatgctagtgaactcaggtg

SEQ ID NO: 423527 - DNA, 32 bp, Artificial Sequence
  Description of Artificial Sequence: Synthetic oligonucleotide
ccagcaactgatgatgctagtgaactcaggtg

SEQ ID NO: 423528 - DNA, 32 bp, Artificial Sequence
  Description of Artificial Sequence: Synthetic oligonucleotide
cagcaactgatgatgctagtgaactcaggtgc

SEQ ID NO: 423529 - DNA, 33 bp, Artificial Sequence
  Description of Artificial Sequence: Synthetic oligonucleotide
agcaactgatgatgctagtgaactcaggtgctg

SEQ ID NO: 423530 - DNA, 32 bp, Artificial Sequence
  Description of Artificial Sequence: Synthetic oligonucleotide
gcaactgatgatgctagtgaactcaggtgctg

SEQ ID NO: 423531 - DNA, 33 bp, Artificial Sequence
  Description of Artificial Sequence: Synthetic oligonucleotide
caactgatgatgctagtgaactcaggtgctgac

SEQ ID NO: 423532 - DNA, 34 bp, Artificial Sequence
  Description of Artificial Sequence: Synthetic oligonucleotide
aactgatgatgctagtgaactcaggtgctgactg

SEQ ID NO: 423533 - DNA, 33 bp, Artificial Sequence
  Description of Artificial Sequence: Synthetic oligonucleotide
actgatgatgctagtgaactcaggtgctgactg

SEQ ID NO: 423534 - DNA, 32 bp, Artificial Sequence
  Description of Artificial Sequence: Synthetic oligonucleotide
ctgatgatgctagtgaactcaggtgctgactg

SEQ ID NO: 423535 - DNA, 32 bp, Artificial Sequence
  Description of Artificial Sequence: Synthetic oligonucleotide
tgatgatgctagtgaactcaggtgctgactgg

SEQ ID NO: 423536 - DNA, 31 bp, Artificial Sequence
  Description of Artificial Sequence: Synthetic oligonucleotide
gatgatgctagtgaactcaggtgctgactgg

SEQ ID NO: 423537 - DNA, 33 bp, Artificial Sequence
  Description of Artificial Sequence: Synthetic oligonucleotide
atgatgctagtgaactcaggtgctgactggttc

SEQ ID NO: 423538 - DNA, 32 bp, Artificial Sequence
  Description of Artificial Sequence: Synthetic oligonucleotide
tgatgctagtgaactcaggtgctgactggttc

SEQ ID NO: 423539 - DNA, 31 bp, Artificial Sequence
  Description of Artificial Sequence: Synthetic oligonucleotide
gatgctagtgaactcaggtgctgactggttc

SEQ ID NO: 423540 - DNA, 32 bp, Artificial Sequence
  Description of Artificial Sequence: Synthetic oligonucleotide
atgctagtgaactcaggtgctgactggttctc

SEQ ID NO: 423541 - DNA, 31 bp, Artificial Sequence
  Description of Artificial Sequence: Synthetic oligonucleotide
tgctagtgaactcaggtgctgactggttctc

SEQ ID NO: 423542 - DNA, 30 bp, Artificial Sequence
  Description of Artificial Sequence: Synthetic oligonucleotide
gctagtgaactcaggtgctgactggttctc

SEQ ID NO: 423543 - DNA, 30 bp, Artificial Sequence
  Description of Artificial Sequence: Synthetic oligonucleotide
ctagtgaactcaggtgctgactggttctcc

SEQ ID NO: 423544 - DNA, 32 bp, Artificial Sequence
  Description of Artificial Sequence: Synthetic oligonucleotide
tagtgaactcaggtgctgactggttctccaac

SEQ ID NO: 423545 - DNA, 31 bp, Artificial Sequence
  Description of Artificial Sequence: Synthetic oligonucleotide
agtgaactcaggtgctgactggttctccaac

SEQ ID NO: 423546 - DNA, 30 bp, Artificial Sequence
  Description of Artificial Sequence: Synthetic oligonucleotide
gtgaactcaggtgctgactggttctccaac

SEQ ID NO: 423547 - DNA, 31 bp, Artificial Sequence
  Description of Artificial Sequence: Synthetic oligonucleotide
tgaactcaggtgctgactggttctccaacac

SEQ ID NO: 423548 - DNA, 30 bp, Artificial Sequence
  Description of Artificial Sequence: Synthetic oligonucleotide
gaactcaggtgctgactggttctccaacac

SEQ ID NO: 423549 - DNA, 30 bp, Artificial Sequence
  Description of Artificial Sequence: Synthetic oligonucleotide
aactcaggtgctgactggttctccaacacg

SEQ ID NO: 423550 - DNA, 29 bp, Artificial Sequence
  Description of Artificial Sequence: Synthetic oligonucleotide
actcaggtgctgactggttctccaacacg

SEQ ID NO: 423551 - DNA, 28 bp, Artificial Sequence
  Description of Artificial Sequence: Synthetic oligonucleotide
ctcaggtgctgactggttctccaacacg

SEQ ID NO: 423552 - DNA, 29 bp, Artificial Sequence
  Description of Artificial Sequence: Synthetic oligonucleotide
tcaggtgctgactggttctccaacacgag

SEQ ID NO: 423553 - DNA, 28 bp, Artificial Sequence
  Description of Artificial Sequence: Synthetic oligonucleotide
caggtgctgactggttctccaacacgag

SEQ ID NO: 423554 - DNA, 32 bp, Artificial Sequence
  Description of Artificial Sequence: Synthetic oligonucleotide
aggtgctgactggttctccaacacgagattac

SEQ ID NO: 423555 - DNA, 31 bp, Artificial Sequence
  Description of Artificial Sequence: Synthetic oligonucleotide
ggtgctgactggttctccaacacgagattac

SEQ ID NO: 423556 - DNA, 31 bp, Artificial Sequence
  Description of Artificial Sequence: Synthetic oligonucleotide
gtgctgactggttctccaacacgagattacc

SEQ ID NO: 423557 - DNA, 44 bp, Artificial Sequence
  Description of Artificial Sequence: Synthetic oligonucleotide
aatcaaggagcaaggaaatcagtaacttccttcctataatttgg

SEQ ID NO: 423558 - DNA, 43 bp, Artificial Sequence
  Description of Artificial Sequence: Synthetic oligonucleotide
atcaaggagcaaggaaatcagtaacttccttcctataatttgg

SEQ ID NO: 423559 - DNA, 42 bp, Artificial Sequence
  Description of Artificial Sequence: Synthetic oligonucleotide
tcaaggagcaaggaaatcagtaacttccttcctataatttgg

SEQ ID NO: 423560 - DNA, 41 bp, Artificial Sequence
  Description of Artificial Sequence: Synthetic oligonucleotide
caaggagcaaggaaatcagtaacttccttcctataatttgg

SEQ ID NO: 423561 - DNA, 44 bp, Artificial Sequence
  Description of Artificial Sequence: Synthetic oligonucleotide
aaggagcaaggaaatcagtaacttccttcctataatttggaatg

SEQ ID NO: 423562 - DNA, 43 bp, Artificial Sequence
  Description of Artificial Sequence: Synthetic oligonucleotide
aggagcaaggaaatcagtaacttccttcctataatttggaatg

SEQ ID NO: 423563 - DNA, 42 bp, Artificial Sequence
  Description of Artificial Sequence: Synthetic oligonucleotide
ggagcaaggaaatcagtaacttccttcctataatttggaatg

SEQ ID NO: 423564 - DNA, 43 bp, Artificial Sequence
  Description of Artificial Sequence: Synthetic oligonucleotide
gagcaaggaaatcagtaacttccttcctataatttggaatgtg

SEQ ID NO: 423565 - DNA, 43 bp, Artificial Sequence
  Description of Artificial Sequence: Synthetic oligonucleotide
agcaaggaaatcagtaacttccttcctataatttggaatgtgg

SEQ ID NO: 423566 - DNA, 42 bp, Artificial Sequence
  Description of Artificial Sequence: Synthetic oligonucleotide
gcaaggaaatcagtaacttccttcctataatttggaatgtgg

SEQ ID NO: 423567 - DNA, 42 bp, Artificial Sequence
  Description of Artificial Sequence: Synthetic oligonucleotide
caaggaaatcagtaacttccttcctataatttggaatgtggg

SEQ ID NO: 423568 - DNA, 43 bp, Artificial Sequence
  Description of Artificial Sequence: Synthetic oligonucleotide
aaggaaatcagtaacttccttcctataatttggaatgtgggtg

SEQ ID NO: 423569 - DNA, 42 bp, Artificial Sequence
  Description of Artificial Sequence: Synthetic oligonucleotide
aggaaatcagtaacttccttcctataatttggaatgtgggtg

SEQ ID NO: 423570 - DNA, 41 bp, Artificial Sequence
  Description of Artificial Sequence: Synthetic oligonucleotide
ggaaatcagtaacttccttcctataatttggaatgtgggtg

SEQ ID NO: 423571 - DNA, 41 bp, Artificial Sequence
  Description of Artificial Sequence: Synthetic oligonucleotide
gaaatcagtaacttccttcctataatttggaatgtgggtgg

SEQ ID NO: 423572 - DNA, 42 bp, Artificial Sequence
  Description of Artificial Sequence: Synthetic oligonucleotide
aaatcagtaacttccttcctataatttggaatgtgggtggag

SEQ ID NO: 423573 - DNA, 41 bp, Artificial Sequence
  Description of Artificial Sequence: Synthetic oligonucleotide
aatcagtaacttccttcctataatttggaatgtgggtggag

SEQ ID NO: 423574 - DNA, 40 bp, Artificial Sequence
  Description of Artificial Sequence: Synthetic oligonucleotide
atcagtaacttccttcctataatttggaatgtgggtggag

SEQ ID NO: 423575 - DNA, 39 bp, Artificial Sequence
  Description of Artificial Sequence: Synthetic oligonucleotide
tcagtaacttccttcctataatttggaatgtgggtggag

SEQ ID NO: 423576 - DNA, 38 bp, Artificial Sequence
  Description of Artificial Sequence: Synthetic oligonucleotide
cagtaacttccttcctataatttggaatgtgggtggag

SEQ ID NO: 423577 - DNA, 38 bp, Artificial Sequence
  Description of Artificial Sequence: Synthetic oligonucleotide
agtaacttccttcctataatttggaatgtgggtggagg

SEQ ID NO: 423578 - DNA, 37 bp, Artificial Sequence
  Description of Artificial Sequence: Synthetic oligonucleotide
gtaacttccttcctataatttggaatgtgggtggagg

SEQ ID NO: 423579 - DNA, 37 bp, Artificial Sequence
  Description of Artificial Sequence: Synthetic oligonucleotide
taacttccttcctataatttggaatgtgggtggaggg

SEQ ID NO: 423580 - DNA, 36 bp, Artificial Sequence
  Description of Artificial Sequence: Synthetic oligonucleotide
aacttccttcctataatttggaatgtgggtggaggg

SEQ ID NO: 423581 - DNA, 35 bp, Artificial Sequence
  Description of Artificial Sequence: Synthetic oligonucleotide
acttccttcctataatttggaatgtgggtggaggg

SEQ ID NO: 423582 - DNA, 34 bp, Artificial Sequence
  Description of Artificial Sequence: Synthetic oligonucleotide
cttccttcctataatttggaatgtgggtggaggg

SEQ ID NO: 423583 - DNA, 34 bp, Artificial Sequence
  Description of Artificial Sequence: Synthetic oligonucleotide
ttccttcctataatttggaatgtgggtggagggg

SEQ ID NO: 423584 - DNA, 33 bp, Artificial Sequence
  Description of Artificial Sequence: Synthetic oligonucleotide
tccttcctataatttggaatgtgggtggagggg

SEQ ID NO: 423585 - DNA, 32 bp, Artificial Sequence
  Description of Artificial Sequence: Synthetic oligonucleotide
ccttcctataatttggaatgtgggtggagggg

SEQ ID NO: 423586 - DNA, 32 bp, Artificial Sequence
  Description of Artificial Sequence: Synthetic oligonucleotide
cttcctataatttggaatgtgggtggaggggg

SEQ ID NO: 423587 - DNA, 32 bp, Artificial Sequence
  Description of Artificial Sequence: Synthetic oligonucleotide
ttcctataatttggaatgtgggtggagggggg

SEQ ID NO: 423588 - DNA, 31 bp, Artificial Sequence
  Description of Artificial Sequence: Synthetic oligonucleotide
tcctataatttggaatgtgggtggagggggg

SEQ ID NO: 423589 - DNA, 30 bp, Artificial Sequence
  Description of Artificial Sequence: Synthetic oligonucleotide
ctataatttggaatgtgggtggaggggggc

SEQ ID NO: 423590 - DNA, 30 bp, Artificial Sequence
  Description of Artificial Sequence: Synthetic oligonucleotide
tataatttggaatgtgggtggaggggggcc

SEQ ID NO: 423591 - DNA, 29 bp, Artificial Sequence
  Description of Artificial Sequence: Synthetic oligonucleotide
ataatttggaatgtgggtggaggggggcc

SEQ ID NO: 423592 - DNA, 28 bp, Artificial Sequence
  Description of Artificial Sequence: Synthetic oligonucleotide
taatttggaatgtgggtggaggggggcc

SEQ ID NO: 423593 - DNA, 27 bp, Artificial Sequence
  Description of Artificial Sequence: Synthetic oligonucleotide
aatttggaatgtgggtggaggggggcc

SEQ ID NO: 423594 - DNA, 27 bp, Artificial Sequence
  Description of Artificial Sequence: Synthetic oligonucleotide
atttggaatgtgggtggaggggggcca

SEQ ID NO: 423595 - DNA, 27 bp, Artificial Sequence
  Description of Artificial Sequence: Synthetic oligonucleotide
tttggaatgtgggtggaggggggccat

SEQ ID NO: 423596 - DNA, 27 bp, Artificial Sequence
  Description of Artificial Sequence: Synthetic oligonucleotide
ttggaatgtgggtggaggggggccata

SEQ ID NO: 423597 - DNA, 26 bp, Artificial Sequence
  Description of Artificial Sequence: Synthetic oligonucleotide
tggaatgtgggtggaggggggccata

SEQ ID NO: 423598 - DNA, 25 bp, Artificial Sequence
  Description of Artificial Sequence: Synthetic oligonucleotide
ggaatgtgggtggaggggggccata

SEQ ID NO: 423599 - DNA, 27 bp, Artificial Sequence
  Description of Artificial Sequence: Synthetic oligonucleotide
gaatgtgggtggaggggggccatagtt

SEQ ID NO: 423600 - DNA, 27 bp, Artificial Sequence
  Description of Artificial Sequence: Synthetic oligonucleotide
aatgtgggtggaggggggccatagttc

SEQ ID NO: 423601 - DNA, 27 bp, Artificial Sequence
  Description of Artificial Sequence: Synthetic oligonucleotide
atgtgggtggaggggggccatagttct

SEQ ID NO: 423602 - DNA, 26 bp, Artificial Sequence
  Description of Artificial Sequence: Synthetic oligonucleotide
tgtgggtggaggggggccatagttct

SEQ ID NO: 423603 - DNA, 25 bp, Artificial Sequence
  Description of Artificial Sequence: Synthetic oligonucleotide
gtgggtggaggggggccatagttct

SEQ ID NO: 423604 - DNA, 25 bp, Artificial Sequence
  Description of Artificial Sequence: Synthetic oligonucleotide
tgggtggaggggggccatagttctc

SEQ ID NO: 423605 - DNA, 24 bp, Artificial Sequence
  Description of Artificial Sequence: Synthetic oligonucleotide
gggtggaggggggccatagttctc

SEQ ID NO: 423606 - DNA, 24 bp, Artificial Sequence
  Description of Artificial Sequence: Synthetic oligonucleotide
ggtggaggggggccatagttctcc

SEQ ID NO: 423607 - DNA, 25 bp, Artificial Sequence
  Description of Artificial Sequence: Synthetic oligonucleotide
gtggaggggggccatagttctccct

SEQ ID NO: 423608 - DNA, 27 bp, Artificial Sequence
  Description of Artificial Sequence: Synthetic oligonucleotide
tggaggggggccatagttctccctgat

SEQ ID NO: 423609 - DNA, 27 bp, Artificial Sequence
  Description of Artificial Sequence: Synthetic oligonucleotide
ggaggggggccatagttctccctgatt

SEQ ID NO: 423610 - DNA, 27 bp, Artificial Sequence
  Description of Artificial Sequence: Synthetic oligonucleotide
gaggggggccatagttctccctgattg

SEQ ID NO: 423611 - DNA, 28 bp, Artificial Sequence
  Description of Artificial Sequence: Synthetic oligonucleotide
aggggggccatagttctccctgattgag

SEQ ID NO: 423612 - DNA, 27 bp, Artificial Sequence
  Description of Artificial Sequence: Synthetic oligonucleotide
ggggggccatagttctccctgattgag

SEQ ID NO: 423613 - DNA, 28 bp, Artificial Sequence
  Description of Artificial Sequence: Synthetic oligonucleotide
gggggccatagttctccctgattgagac

SEQ ID NO: 423614 - DNA, 30 bp, Artificial Sequence
  Description of Artificial Sequence: Synthetic oligonucleotide
ggggccatagttctccctgattgagacttg

SEQ ID NO: 423615 - DNA, 30 bp, Artificial Sequence
  Description of Artificial Sequence: Synthetic oligonucleotide
gggccatagttctccctgattgagacttgc

SEQ ID NO: 423616 - DNA, 30 bp, Artificial Sequence
  Description of Artificial Sequence: Synthetic oligonucleotide
ggccatagttctccctgattgagacttgcc

SEQ ID NO: 423617 - DNA, 31 bp, Artificial Sequence
  Description of Artificial Sequence: Synthetic oligonucleotide
gccatagttctccctgattgagacttgcctg

SEQ ID NO: 423618 - DNA, 31 bp, Artificial Sequence
  Description of Artificial Sequence: Synthetic oligonucleotide
ccatagttctccctgattgagacttgcctgc

SEQ ID NO: 423619 - DNA, 32 bp, Artificial Sequence
  Description of Artificial Sequence: Synthetic oligonucleotide
catagttctccctgattgagacttgcctgctg

SEQ ID NO: 423620 - DNA, 32 bp, Artificial Sequence
  Description of Artificial Sequence: Synthetic oligonucleotide
atagttctccctgattgagacttgcctgctgc

SEQ ID NO: 423621 - DNA, 31 bp, Artificial Sequence
  Description of Artificial Sequence: Synthetic oligonucleotide
tagttctccctgattgagacttgcctgctgc

SEQ ID NO: 423622 - DNA, 30 bp, Artificial Sequence
  Description of Artificial Sequence: Synthetic oligonucleotide
agttctccctgattgagacttgcctgctgc

SEQ ID NO: 423623 - DNA, 29 bp, Artificial Sequence
  Description of Artificial Sequence: Synthetic oligonucleotide
gttctccctgattgagacttgcctgctgc

SEQ ID NO: 423624 - DNA, 30 bp, Artificial Sequence
  Description of Artificial Sequence: Synthetic oligonucleotide
ttctccctgattgagacttgcctgctgctg

SEQ ID NO: 423625 - DNA, 29 bp, Artificial Sequence
  Description of Artificial Sequence: Synthetic oligonucleotide
tctccctgattgagacttgcctgctgctg

SEQ ID NO: 423626 - DNA, 28 bp, Artificial Sequence
  Description of Artificial Sequence: Synthetic oligonucleotide
ctccctgattgagacttgcctgctgctg

SEQ ID NO: 423627 - DNA, 29 bp, Artificial Sequence
  Description of Artificial Sequence: Synthetic oligonucleotide
tccctgattgagacttgcctgctgctgtg

SEQ ID NO: 423628 - DNA, 28 bp, Artificial Sequence
  Description of Artificial Sequence: Synthetic oligonucleotide
ccctgattgagacttgcctgctgctgtg

SEQ ID NO: 423629 - DNA, 29 bp, Artificial Sequence
  Description of Artificial Sequence: Synthetic oligonucleotide
cctgattgagacttgcctgctgctgtgac

SEQ ID NO: 423630 - DNA, 29 bp, Artificial Sequence
  Description of Artificial Sequence: Synthetic oligonucleotide
ctgattgagacttgcctgctgctgtgacc

SEQ ID NO: 423631 - DNA, 30 bp, Artificial Sequence
  Description of Artificial Sequence: Synthetic oligonucleotide
tgattgagacttgcctgctgctgtgaccac

SEQ ID NO: 423632 - DNA, 29 bp, Artificial Sequence
  Description of Artificial Sequence: Synthetic oligonucleotide
gattgagacttgcctgctgctgtgaccac

SEQ ID NO: 423633 - DNA, 30 bp, Artificial Sequence
  Description of Artificial Sequence: Synthetic oligonucleotide
attgagacttgcctgctgctgtgaccactg

SEQ ID NO: 423634 - DNA, 29 bp, Artificial Sequence
  Description of Artificial Sequence: Synthetic oligonucleotide
ttgagacttgcctgctgctgtgaccactg

SEQ ID NO: 423635 - DNA, 28 bp, Artificial Sequence
  Description of Artificial Sequence: Synthetic oligonucleotide
tgagacttgcctgctgctgtgaccactg

SEQ ID NO: 423636 - DNA, 27 bp, Artificial Sequence
  Description of Artificial Sequence: Synthetic oligonucleotide
gagacttgcctgctgctgtgaccactg

SEQ ID NO: 423637 - DNA, 27 bp, Artificial Sequence
  Description of Artificial Sequence: Synthetic oligonucleotide
agacttgcctgctgctgtgaccactgg

SEQ ID NO: 423638 - DNA, 27 bp, Artificial Sequence
  Description of Artificial Sequence: Synthetic oligonucleotide
gacttgcctgctgctgtgaccactggt

SEQ ID NO: 423639 - DNA, 27 bp, Artificial Sequence
  Description of Artificial Sequence: Synthetic oligonucleotide
acttgcctgctgctgtgaccactggtc

SEQ ID NO: 423640 - DNA, 27 bp, Artificial Sequence
  Description of Artificial Sequence: Synthetic oligonucleotide
cttgcctgctgctgtgaccactggtct

SEQ ID NO: 423641 - DNA, 28 bp, Artificial Sequence
  Description of Artificial Sequence: Synthetic oligonucleotide
ttgcctgctgctgtgaccactggtcttg

SEQ ID NO: 423642 - DNA, 27 bp, Artificial Sequence
  Description of Artificial Sequence: Synthetic oligonucleotide
tgcctgctgctgtgaccactggtcttg

SEQ ID NO: 423643 - DNA, 27 bp, Artificial Sequence
  Description of Artificial Sequence: Synthetic oligonucleotide
gcctgctgctgtgaccactggtcttgt

SEQ ID NO: 423644 - DNA, 27 bp, Artificial Sequence
  Description of Artificial Sequence: Synthetic oligonucleotide
cctgctgctgtgaccactggtcttgtc

SEQ ID NO: 423645 - DNA, 27 bp, Artificial Sequence
  Description of Artificial Sequence: Synthetic oligonucleotide
ctgctgctgtgaccactggtcttgtcc

SEQ ID NO: 423646 - DNA, 28 bp, Artificial Sequence
  Description of Artificial Sequence: Synthetic oligonucleotide
tgctgctgtgaccactggtcttgtcctc

SEQ ID NO: 423647 - DNA, 27 bp, Artificial Sequence
  Description of Artificial Sequence: Synthetic oligonucleotide
gctgctgtgaccactggtcttgtcctc

SEQ ID NO: 423648 - DNA, 29 bp, Artificial Sequence
  Description of Artificial Sequence: Synthetic oligonucleotide
ctgctgtgaccactggtcttgtcctcttc

SEQ ID NO: 423649 - DNA, 30 bp, Artificial Sequence
  Description of Artificial Sequence: Synthetic oligonucleotide
tgctgtgaccactggtcttgtcctcttctc

SEQ ID NO: 423650 - DNA, 29 bp, Artificial Sequence
  Description of Artificial Sequence: Synthetic oligonucleotide
gctgtgaccactggtcttgtcctcttctc

SEQ ID NO: 423651 - DNA, 29 bp, Artificial Sequence
  Description of Artificial Sequence: Synthetic oligonucleotide
ctgtgaccactggtcttgtcctcttctcc

SEQ ID NO: 423652 - DNA, 30 bp, Artificial Sequence
  Description of Artificial Sequence: Synthetic oligonucleotide
tgtgaccactggtcttgtcctcttctccag

SEQ ID NO: 423653 - DNA, 29 bp, Artificial Sequence
  Description of Artificial Sequence: Synthetic oligonucleotide
gtgaccactggtcttgtcctcttctccag

SEQ ID NO: 423654 - DNA, 30 bp, Artificial Sequence; identical to SEQ ID NO: 74781
  Description of Artificial Sequence: Synthetic oligonucleotide

SEQ ID NO: 423655 - DNA, 29 bp, Artificial Sequence
  Description of Artificial Sequence: Synthetic oligonucleotide
gcatccaagcatgatgagccctctcacag

SEQ ID NO: 423656 - DNA, 30 bp, Artificial Sequence; identical to SEQ ID NO: 74783
  Description of Artificial Sequence: Synthetic oligonucleotide

SEQ ID NO: 423657 - DNA, 30 bp, Artificial Sequence; identical to SEQ ID NO: 74784
  Description of Artificial Sequence: Synthetic oligonucleotide

SEQ ID NO: 423658 - DNA, 29 bp, Artificial Sequence
  Description of Artificial Sequence: Synthetic oligonucleotide
tccaagcatgatgagccctctcacagtgc

SEQ ID NO: 423659 - DNA, 28 bp, Artificial Sequence
  Description of Artificial Sequence: Synthetic oligonucleotide
ccaagcatgatgagccctctcacagtgc

SEQ ID NO: 423660 - DNA, 31 bp, Artificial Sequence; identical to SEQ ID NO: 74787
  Description of Artificial Sequence: Synthetic oligonucleotide

SEQ ID NO: 423661 - DNA, 31 bp, Artificial Sequence; identical to SEQ ID NO: 74788
  Description of Artificial Sequence: Synthetic oligonucleotide

SEQ ID NO: 423662 - DNA, 30 bp, Artificial Sequence; identical to SEQ ID NO: 74789
  Description of Artificial Sequence: Synthetic oligonucleotide

SEQ ID NO: 423663 - DNA, 29 bp, Artificial Sequence
  Description of Artificial Sequence: Synthetic oligonucleotide
gcatgatgagccctctcacagtgcaatgg

SEQ ID NO: 423664 - DNA, 30 bp, Artificial Sequence; identical to SEQ ID NO: 74791
  Description of Artificial Sequence: Synthetic oligonucleotide

SEQ ID NO: 423665 - DNA, 31 bp, Artificial Sequence; identical to SEQ ID NO: 74792
  Description of Artificial Sequence: Synthetic oligonucleotide

SEQ ID NO: 423666 - DNA, 30 bp, Artificial Sequence; identical to SEQ ID NO: 74793
  Description of Artificial Sequence: Synthetic oligonucleotide

SEQ ID NO: 423667 - DNA, 29 bp, Artificial Sequence
  Description of Artificial Sequence: Synthetic oligonucleotide
gatgagccctctcacagtgcaatggagtg

SEQ ID NO: 423668 - DNA, 29 bp, Artificial Sequence
  Description of Artificial Sequence: Synthetic oligonucleotide
atgagccctctcacagtgcaatggagtgc

SEQ ID NO: 423669 - DNA, 28 bp, Artificial Sequence
  Description of Artificial Sequence: Synthetic oligonucleotide
tgagccctctcacagtgcaatggagtgc

SEQ ID NO: 423670 - DNA, 27 bp, Artificial Sequence
  Description of Artificial Sequence: Synthetic oligonucleotide
gagccctctcacagtgcaatggagtgc

SEQ ID NO: 423671 - DNA, 28 bp, Artificial Sequence
  Description of Artificial Sequence: Synthetic oligonucleotide
agccctctcacagtgcaatggagtgcac

SEQ ID NO: 423672 - DNA, 27 bp, Artificial Sequence
  Description of Artificial Sequence: Synthetic oligonucleotide
gccctctcacagtgcaatggagtgcac

SEQ ID NO: 423673 - DNA, 27 bp, Artificial Sequence
  Description of Artificial Sequence: Synthetic oligonucleotide
ccctctcacagtgcaatggagtgcacg

SEQ ID NO: 423674 - DNA, 27 bp, Artificial Sequence
  Description of Artificial Sequence: Synthetic oligonucleotide
cctctcacagtgcaatggagtgcacgg

SEQ ID NO: 423675 - DNA, 28 bp, Artificial Sequence
  Description of Artificial Sequence: Synthetic oligonucleotide
ctctcacagtgcaatggagtgcacggtc

SEQ ID NO: 423676 - DNA, 29 bp, Artificial Sequence
  Description of Artificial Sequence: Synthetic oligonucleotide
tctcacagtgcaatggagtgcacggtctg

SEQ ID NO: 423677 - DNA, 28 bp, Artificial Sequence
  Description of Artificial Sequence: Synthetic oligonucleotide
ctcacagtgcaatggagtgcacggtctg

SEQ ID NO: 423678 - DNA, 31 bp, Artificial Sequence; identical to SEQ ID NO: 74805
  Description of Artificial Sequence: Synthetic oligonucleotide

SEQ ID NO: 423679 - DNA, 30 bp, Artificial Sequence; identical to SEQ ID NO: 74806
  Description of Artificial Sequence: Synthetic oligonucleotide

SEQ ID NO: 423680 - DNA, 31 bp, Artificial Sequence; identical to SEQ ID NO: 74807
  Description of Artificial Sequence: Synthetic oligonucleotide

SEQ ID NO: 423681 - DNA, 30 bp, Artificial Sequence; identical to SEQ ID NO: 74808
  Description of Artificial Sequence: Synthetic oligonucleotide

SEQ ID NO: 423682 - DNA, 30 bp, Artificial Sequence; identical to SEQ ID NO: 74809
  Description of Artificial Sequence: Synthetic oligonucleotide

SEQ ID NO: 423683 - DNA, 27 bp, Artificial Sequence
  Description of Artificial Sequence: Synthetic oligonucleotide
gggccgaggtggacacctattgcagat

SEQ ID NO: 423684 - DNA, 28 bp, Artificial Sequence
  Description of Artificial Sequence: Synthetic oligonucleotide
ggccgaggtggacacctattgcagatac

SEQ ID NO: 423685 - DNA, 30 bp, Artificial Sequence; identical to SEQ ID NO: 74812
  Description of Artificial Sequence: Synthetic oligonucleotide

SEQ ID NO: 423686 - DNA, 32 bp, Artificial Sequence; identical to SEQ ID NO: 74813
  Description of Artificial Sequence: Synthetic oligonucleotide

SEQ ID NO: 423687 - DNA, 32 bp, Artificial Sequence; identical to SEQ ID NO: 74814
  Description of Artificial Sequence: Synthetic oligonucleotide

SEQ ID NO: 423688 - DNA, 32 bp, Artificial Sequence; identical to SEQ ID NO: 74815
  Description of Artificial Sequence: Synthetic oligonucleotide

SEQ ID NO: 423689 - DNA, 32 bp, Artificial Sequence; identical to SEQ ID NO: 74816
  Description of Artificial Sequence: Synthetic oligonucleotide

SEQ ID NO: 423690 - DNA, 31 bp, Artificial Sequence; identical to SEQ ID NO: 74817
  Description of Artificial Sequence: Synthetic oligonucleotide

SEQ ID NO: 423691 - DNA, 31 bp, Artificial Sequence; identical to SEQ ID NO: 74818
  Description of Artificial Sequence: Synthetic oligonucleotide

SEQ ID NO: 423692 - DNA, 33 bp, Artificial Sequence; identical to SEQ ID NO: 74819
  Description of Artificial Sequence: Synthetic oligonucleotide

SEQ ID NO: 423693 - DNA, 32 bp, Artificial Sequence; identical to SEQ ID NO: 74820
  Description of Artificial Sequence: Synthetic oligonucleotide

SEQ ID NO: 423694 - DNA, 33 bp, Artificial Sequence; identical to SEQ ID NO: 74821
  Description of Artificial Sequence: Synthetic oligonucleotide

SEQ ID NO: 423695 - DNA, 33 bp, Artificial Sequence; identical to SEQ ID NO: 74822
  Description of Artificial Sequence: Synthetic oligonucleotide

SEQ ID NO: 423696 - DNA, 32 bp, Artificial Sequence; identical to SEQ ID NO: 74823
  Description of Artificial Sequence: Synthetic oligonucleotide

SEQ ID NO: 423697 - DNA, 33 bp, Artificial Sequence; identical to SEQ ID NO: 74824
  Description of Artificial Sequence: Synthetic oligonucleotide

SEQ ID NO: 423698 - DNA, 32 bp, Artificial Sequence; identical to SEQ ID NO: 74825
  Description of Artificial Sequence: Synthetic oligonucleotide

SEQ ID NO: 423699 - DNA, 33 bp, Artificial Sequence; identical to SEQ ID NO: 74826
  Description of Artificial Sequence: Synthetic oligonucleotide

SEQ ID NO: 423700 - DNA, 33 bp, Artificial Sequence; identical to SEQ ID NO: 74827
  Description of Artificial Sequence: Synthetic oligonucleotide

SEQ ID NO: 423701 - DNA, 32 bp, Artificial Sequence; identical to SEQ ID NO: 74828
  Description of Artificial Sequence: Synthetic oligonucleotide

SEQ ID NO: 423702 - DNA, 31 bp, Artificial Sequence; identical to SEQ ID NO: 74829
  Description of Artificial Sequence: Synthetic oligonucleotide

SEQ ID NO: 423703 - DNA, 30 bp, Artificial Sequence; identical to SEQ ID NO: 74830
  Description of Artificial Sequence: Synthetic oligonucleotide

SEQ ID NO: 423704 - DNA, 29 bp, Artificial Sequence
  Description of Artificial Sequence: Synthetic oligonucleotide
agaggagtacgcgcgctacaacagtgatc

SEQ ID NO: 423705 - DNA, 28 bp, Artificial Sequence
  Description of Artificial Sequence: Synthetic oligonucleotide
gaggagtacgcgcgctacaacagtgatc

SEQ ID NO: 423706 - DNA, 29 bp, Artificial Sequence
  Description of Artificial Sequence: Synthetic oligonucleotide
aggagtacgcgcgctacaacagtgatctg

SEQ ID NO: 423707 - DNA, 28 bp, Artificial Sequence
  Description of Artificial Sequence: Synthetic oligonucleotide
ggagtacgcgcgctacaacagtgatctg

SEQ ID NO: 423708 - DNA, 28 bp, Artificial Sequence
  Description of Artificial Sequence: Synthetic oligonucleotide
gagtacgcgcgctacaacagtgatctgg

SEQ ID NO: 423709 - DNA, 28 bp, Artificial Sequence
  Description of Artificial Sequence: Synthetic oligonucleotide
agtacgcgcgctacaacagtgatctggg

SEQ ID NO: 423710 - DNA, 27 bp, Artificial Sequence
  Description of Artificial Sequence: Synthetic oligonucleotide
gtacgcgcgctacaacagtgatctggg

SEQ ID NO: 423711 - DNA, 27 bp, Artificial Sequence
  Description of Artificial Sequence: Synthetic oligonucleotide
tacgcgcgctacaacagtgatctgggg

SEQ ID NO: 423712 - DNA, 26 bp, Artificial Sequence
  Description of Artificial Sequence: Synthetic oligonucleotide
acgcgcgctacaacagtgatctgggg

SEQ ID NO: 423713 - DNA, 25 bp, Artificial Sequence
  Description of Artificial Sequence: Synthetic oligonucleotide
cgcgcgctacaacagtgatctgggg

SEQ ID NO: 423714 - DNA, 26 bp, Artificial Sequence
  Description of Artificial Sequence: Synthetic oligonucleotide
gcgcgctacaacagtgatctggggga

SEQ ID NO: 423715 - DNA, 27 bp, Artificial Sequence
  Description of Artificial Sequence: Synthetic oligonucleotide
cgcgctacaacagtgatctgggggagt

SEQ ID NO: 423716 - DNA, 28 bp, Artificial Sequence
  Description of Artificial Sequence: Synthetic oligonucleotide
gcgctacaacagtgatctgggggagtac

SEQ ID NO: 423717 - DNA, 28 bp, Artificial Sequence
  Description of Artificial Sequence: Synthetic oligonucleotide
cgctacaacagtgatctgggggagtacc

SEQ ID NO: 423718 - DNA, 29 bp, Artificial Sequence
  Description of Artificial Sequence: Synthetic oligonucleotide
gctacaacagtgatctgggggagtaccag

SEQ ID NO: 423719 - DNA, 29 bp, Artificial Sequence
  Description of Artificial Sequence: Synthetic oligonucleotide
ctacaacagtgatctgggggagtaccagg

SEQ ID NO: 423720 - DNA, 29 bp, Artificial Sequence
  Description of Artificial Sequence: Synthetic oligonucleotide
tacaacagtgatctgggggagtaccaggc

SEQ ID NO: 423721 - DNA, 28 bp, Artificial Sequence
  Description of Artificial Sequence: Synthetic oligonucleotide
acaacagtgatctgggggagtaccaggc

SEQ ID NO: 423722 - DNA, 27 bp, Artificial Sequence
  Description of Artificial Sequence: Synthetic oligonucleotide
caacagtgatctgggggagtaccaggc

SEQ ID NO: 423723 - DNA, 27 bp, Artificial Sequence
  Description of Artificial Sequence: Synthetic oligonucleotide
aacagtgatctgggggagtaccaggcg

SEQ ID NO: 423724 - DNA, 26 bp, Artificial Sequence
  Description of Artificial Sequence: Synthetic oligonucleotide
acagtgatctgggggagtaccaggcg

SEQ ID NO: 423725 - DNA, 25 bp, Artificial Sequence
  Description of Artificial Sequence: Synthetic oligonucleotide
cagtgatctgggggagtaccaggcg

SEQ ID NO: 423726 - DNA, 26 bp, Artificial Sequence
  Description of Artificial Sequence: Synthetic oligonucleotide
agtgatctgggggagtaccaggcggt

SEQ ID NO: 423727 - DNA, 25 bp, Artificial Sequence
  Description of Artificial Sequence: Synthetic oligonucleotide
gtgatctgggggagtaccaggcggt

SEQ ID NO: 423728 - DNA, 26 bp, Artificial Sequence
  Description of Artificial Sequence: Synthetic oligonucleotide
tgatctgggggagtaccaggcggtga

SEQ ID NO: 423729 - DNA, 25 bp, Artificial Sequence
  Description of Artificial Sequence: Synthetic oligonucleotide
gatctgggggagtaccaggcggtga

SEQ ID NO: 423730 - DNA, 25 bp, Artificial Sequence
  Description of Artificial Sequence: Synthetic oligonucleotide
atctgggggagtaccaggcggtgac

SEQ ID NO: 423731 - DNA, 24 bp, Artificial Sequence
  Description of Artificial Sequence: Synthetic oligonucleotide
tctgggggagtaccaggcggtgac

SEQ ID NO: 423732 - DNA, 27 bp, Artificial Sequence
  Description of Artificial Sequence: Synthetic oligonucleotide
gggccgaggtggacaactactgcagat

SEQ ID NO: 423733 - DNA, 28 bp, Artificial Sequence
  Description of Artificial Sequence: Synthetic oligonucleotide
ggccgaggtggacaactactgcagatac

SEQ ID NO: 423734 - DNA, 30 bp, Artificial Sequence; identical to SEQ ID NO: 74861
  Description of Artificial Sequence: Synthetic oligonucleotide

SEQ ID NO: 423735 - DNA, 32 bp, Artificial Sequence; identical to SEQ ID NO: 74862
  Description of Artificial Sequence: Synthetic oligonucleotide

SEQ ID NO: 423736 - DNA, 32 bp, Artificial Sequence; identical to SEQ ID NO: 74863
  Description of Artificial Sequence: Synthetic oligonucleotide

SEQ ID NO: 423737 - DNA, 32 bp, Artificial Sequence; identical to SEQ ID NO: 74864
  Description of Artificial Sequence: Synthetic oligonucleotide

SEQ ID NO: 423738 - DNA, 32 bp, Artificial Sequence; identical to SEQ ID NO: 74865
  Description of Artificial Sequence: Synthetic oligonucleotide

SEQ ID NO: 423739 - DNA, 31 bp, Artificial Sequence; identical to SEQ ID NO: 74866
  Description of Artificial Sequence: Synthetic oligonucleotide

SEQ ID NO: 423740 - DNA, 31 bp, Artificial Sequence; identical to SEQ ID NO: 74867
  Description of Artificial Sequence: Synthetic oligonucleotide

SEQ ID NO: 423741 - DNA, 33 bp, Artificial Sequence; identical to SEQ ID NO: 74868
  Description of Artificial Sequence: Synthetic oligonucleotide

SEQ ID NO: 423742 - DNA, 32 bp, Artificial Sequence; identical to SEQ ID NO: 74869
  Description of Artificial Sequence: Synthetic oligonucleotide

SEQ ID NO: 423743 - DNA, 33 bp, Artificial Sequence; identical to SEQ ID NO: 74870
  Description of Artificial Sequence: Synthetic oligonucleotide

SEQ ID NO: 423744 - DNA, 33 bp, Artificial Sequence; identical to SEQ ID NO: 74871
  Description of Artificial Sequence: Synthetic oligonucleotide

SEQ ID NO: 423745 - DNA, 32 bp, Artificial Sequence; identical to SEQ ID NO: 74872
  Description of Artificial Sequence: Synthetic oligonucleotide

SEQ ID NO: 423746 - DNA, 33 bp, Artificial Sequence; identical to SEQ ID NO: 74873
  Description of Artificial Sequence: Synthetic oligonucleotide

SEQ ID NO: 423747 - DNA, 32 bp, Artificial Sequence; identical to SEQ ID NO: 74874
  Description of Artificial Sequence: Synthetic oligonucleotide

SEQ ID NO: 423748 - DNA, 25 bp, Artificial Sequence
  Description of Artificial Sequence: Synthetic oligonucleotide
ccagcccctgcagcactacaacctc

SEQ ID NO: 423749 - DNA, 26 bp, Artificial Sequence
  Description of Artificial Sequence: Synthetic oligonucleotide
cagcccctgcagcactacaacctcct

SEQ ID NO: 423750 - DNA, 26 bp, Artificial Sequence
  Description of Artificial Sequence: Synthetic oligonucleotide
agcccctgcagcactacaacctcctg

SEQ ID NO: 423751 - DNA, 25 bp, Artificial Sequence
  Description of Artificial Sequence: Synthetic oligonucleotide
gcccctgcagcactacaacctcctg

SEQ ID NO: 423752 - DNA, 26 bp, Artificial Sequence
  Description of Artificial Sequence: Synthetic oligonucleotide
cccctgcagcactacaacctcctggt

SEQ ID NO: 423753 - DNA, 27 bp, Artificial Sequence
  Description of Artificial Sequence: Synthetic oligonucleotide
ccctgcagcactacaacctcctggtct

SEQ ID NO: 423754 - DNA, 27 bp, Artificial Sequence
  Description of Artificial Sequence: Synthetic oligonucleotide
cctgcagcactacaacctcctggtctg

SEQ ID NO: 423755 - DNA, 27 bp, Artificial Sequence
  Description of Artificial Sequence: Synthetic oligonucleotide
ctgcagcactacaacctcctggtctgc

SEQ ID NO: 423756 - DNA, 28 bp, Artificial Sequence
  Description of Artificial Sequence: Synthetic oligonucleotide
tgcagcactacaacctcctggtctgctc

SEQ ID NO: 423757 - DNA, 27 bp, Artificial Sequence
  Description of Artificial Sequence: Synthetic oligonucleotide
gcagcactacaacctcctggtctgctc

SEQ ID NO: 423758 - DNA, 28 bp, Artificial Sequence
  Description of Artificial Sequence: Synthetic oligonucleotide
cagcactacaacctcctggtctgctctg

SEQ ID NO: 423759 - DNA, 29 bp, Artificial Sequence
  Description of Artificial Sequence: Synthetic oligonucleotide
agcactacaacctcctggtctgctctgtg

SEQ ID NO: 423760 - DNA, 28 bp, Artificial Sequence
  Description of Artificial Sequence: Synthetic oligonucleotide
gcactacaacctcctggtctgctctgtg

SEQ ID NO: 423761 - DNA, 31 bp, Artificial Sequence; identical to SEQ ID NO: 74888
  Description of Artificial Sequence: Synthetic oligonucleotide

SEQ ID NO: 423762 - DNA, 31 bp, Artificial Sequence; identical to SEQ ID NO: 74889
  Description of Artificial Sequence: Synthetic oligonucleotide

SEQ ID NO: 423763 - DNA, 30 bp, Artificial Sequence; identical to SEQ ID NO: 74890
  Description of Artificial Sequence: Synthetic oligonucleotide

SEQ ID NO: 423764 - DNA, 33 bp, Artificial Sequence; identical to SEQ ID NO: 74891
  Description of Artificial Sequence: Synthetic oligonucleotide

SEQ ID NO: 423765 - DNA, 31 bp, Artificial Sequence; identical to SEQ ID NO: 74892
  Description of Artificial Sequence: Synthetic oligonucleotide

SEQ ID NO: 423766 - DNA, 31 bp, Artificial Sequence; identical to SEQ ID NO: 74893
  Description of Artificial Sequence: Synthetic oligonucleotide

SEQ ID NO: 423767 - DNA, 30 bp, Artificial Sequence; identical to SEQ ID NO: 74894
  Description of Artificial Sequence: Synthetic oligonucleotide

SEQ ID NO: 423768 - DNA, 30 bp, Artificial Sequence; identical to SEQ ID NO: 74895
  Description of Artificial Sequence: Synthetic oligonucleotide

SEQ ID NO: 423769 - DNA, 30 bp, Artificial Sequence; identical to SEQ ID NO: 74896
  Description of Artificial Sequence: Synthetic oligonucleotide

SEQ ID NO: 423770 - DNA, 29 bp, Artificial Sequence
  Description of Artificial Sequence: Synthetic oligonucleotide
ggacacctactgcagatacaactaccggg

SEQ ID NO: 423771 - DNA, 31 bp, Artificial Sequence; identical to SEQ ID NO: 74898
  Description of Artificial Sequence: Synthetic oligonucleotide

SEQ ID NO: 423772 - DNA, 32 bp, Artificial Sequence; identical to SEQ ID NO: 74899
  Description of Artificial Sequence: Synthetic oligonucleotide

SEQ ID NO: 423773 - DNA, 31 bp, Artificial Sequence; identical to SEQ ID NO: 74900
  Description of Artificial Sequence: Synthetic oligonucleotide

SEQ ID NO: 423774 - DNA, 31 bp, Artificial Sequence; identical to SEQ ID NO: 74901
  Description of Artificial Sequence: Synthetic oligonucleotide

SEQ ID NO: 423775 - DNA, 30 bp, Artificial Sequence; identical to SEQ ID NO: 74902
  Description of Artificial Sequence: Synthetic oligonucleotide

SEQ ID NO: 423776 - DNA, 31 bp, Artificial Sequence; identical to SEQ ID NO: 74903
  Description of Artificial Sequence: Synthetic oligonucleotide

SEQ ID NO: 423777 - DNA, 32 bp, Artificial Sequence; identical to SEQ ID NO: 74904
  Description of Artificial Sequence: Synthetic oligonucleotide

SEQ ID NO: 423778 - DNA, 31 bp, Artificial Sequence; identical to SEQ ID NO: 74905
  Description of Artificial Sequence: Synthetic oligonucleotide

SEQ ID NO: 423779 - DNA, 30 bp, Artificial Sequence; identical to SEQ ID NO: 74906
  Description of Artificial Sequence: Synthetic oligonucleotide

SEQ ID NO: 423780 - DNA, 30 bp, Artificial Sequence; identical to SEQ ID NO: 74907
  Description of Artificial Sequence: Synthetic oligonucleotide

SEQ ID NO: 423781 - DNA, 29 bp, Artificial Sequence
  Description of Artificial Sequence: Synthetic oligonucleotide
gcagatacaactaccgggttgtggagagc

SEQ ID NO: 423782 - DNA, 31 bp, Artificial Sequence; identical to SEQ ID NO: 74909
  Description of Artificial Sequence: Synthetic oligonucleotide

SEQ ID NO: 423783 - DNA, 32 bp, Artificial Sequence; identical to SEQ ID NO: 74910
  Description of Artificial Sequence: Synthetic oligonucleotide

SEQ ID NO: 423784 - DNA, 31 bp, Artificial Sequence; identical to SEQ ID NO: 74911
  Description of Artificial Sequence: Synthetic oligonucleotide

SEQ ID NO: 423785 - DNA, 32 bp, Artificial Sequence; identical to SEQ ID NO: 74912
  Description of Artificial Sequence: Synthetic oligonucleotide

SEQ ID NO: 423786 - DNA, 31 bp, Artificial Sequence; identical to SEQ ID NO: 74913
  Description of Artificial Sequence: Synthetic oligonucleotide

SEQ ID NO: 423787 - DNA, 30 bp, Artificial Sequence; identical to SEQ ID NO: 74914
  Description of Artificial Sequence: Synthetic oligonucleotide

SEQ ID NO: 423788 - DNA, 29 bp, Artificial Sequence
  Description of Artificial Sequence: Synthetic oligonucleotide
caactaccgggttgtggagagcttcacag

SEQ ID NO: 423789 - DNA, 30 bp, Artificial Sequence; identical to SEQ ID NO: 74916
  Description of Artificial Sequence: Synthetic oligonucleotide

SEQ ID NO: 423790 - DNA, 29 bp, Artificial Sequence
  Description of Artificial Sequence: Synthetic oligonucleotide
actaccgggttgtggagagcttcacagtg

SEQ ID NO: 423791 - DNA, 28 bp, Artificial Sequence
  Description of Artificial Sequence: Synthetic oligonucleotide
ctaccgggttgtggagagcttcacagtg

SEQ ID NO: 423792 - DNA, 28 bp, Artificial Sequence
  Description of Artificial Sequence: Synthetic oligonucleotide
taccgggttgtggagagcttcacagtgc

SEQ ID NO: 423793 - DNA, 27 bp, Artificial Sequence
  Description of Artificial Sequence: Synthetic oligonucleotide
accgggttgtggagagcttcacagtgc

SEQ ID NO: 423794 - DNA, 27 bp, Artificial Sequence
  Description of Artificial Sequence: Synthetic oligonucleotide
ccgggttgtggagagcttcacagtgca

SEQ ID NO: 423795 - DNA, 27 bp, Artificial Sequence
  Description of Artificial Sequence: Synthetic oligonucleotide
cgggttgtggagagcttcacagtgcag

SEQ ID NO: 423796 - DNA, 33 bp, Artificial Sequence; identical to SEQ ID NO: 74923
  Description of Artificial Sequence: Synthetic oligonucleotide

SEQ ID NO: 423797 - DNA, 32 bp, Artificial Sequence; identical to SEQ ID NO: 74924
  Description of Artificial Sequence: Synthetic oligonucleotide

SEQ ID NO: 423798 - DNA, 33 bp, Artificial Sequence; identical to SEQ ID NO: 74925
  Description of Artificial Sequence: Synthetic oligonucleotide

SEQ ID NO: 423799 - DNA, 33 bp, Artificial Sequence; identical to SEQ ID NO: 74926
  Description of Artificial Sequence: Synthetic oligonucleotide

SEQ ID NO: 423800 - DNA, 32 bp, Artificial Sequence; identical to SEQ ID NO: 74927
  Description of Artificial Sequence: Synthetic oligonucleotide

SEQ ID NO: 423801 - DNA, 31 bp, Artificial Sequence; identical to SEQ ID NO: 74928
  Description of Artificial Sequence: Synthetic oligonucleotide

SEQ ID NO: 423802 - DNA, 33 bp, Artificial Sequence; identical to SEQ ID NO: 74929
  Description of Artificial Sequence: Synthetic oligonucleotide

SEQ ID NO: 423803 - DNA, 32 bp, Artificial Sequence; identical to SEQ ID NO: 74930
  Description of Artificial Sequence: Synthetic oligonucleotide

SEQ ID NO: 423804 - DNA, 33 bp, Artificial Sequence; identical to SEQ ID NO: 74931
  Description of Artificial Sequence: Synthetic oligonucleotide

SEQ ID NO: 423805 - DNA, 34 bp, Artificial Sequence; identical to SEQ ID NO: 74932
  Description of Artificial Sequence: Synthetic oligonucleotide

SEQ ID NO: 423806 - DNA, 33 bp, Artificial Sequence; identical to SEQ ID NO: 74933
  Description of Artificial Sequence: Synthetic oligonucleotide

SEQ ID NO: 423807 - DNA, 34 bp, Artificial Sequence; identical to SEQ ID NO: 74934
  Description of Artificial Sequence: Synthetic oligonucleotide

SEQ ID NO: 423808 - DNA, 33 bp, Artificial Sequence; identical to SEQ ID NO: 74935
  Description of Artificial Sequence: Synthetic oligonucleotide

SEQ ID NO: 423809 - DNA, 32 bp, Artificial Sequence; identical to SEQ ID NO: 74936
  Description of Artificial Sequence: Synthetic oligonucleotide

SEQ ID NO: 423810 - DNA, 31 bp, Artificial Sequence; identical to SEQ ID NO: 74937
  Description of Artificial Sequence: Synthetic oligonucleotide

SEQ ID NO: 423811 - DNA, 31 bp, Artificial Sequence; identical to SEQ ID NO: 74938
  Description of Artificial Sequence: Synthetic oligonucleotide

SEQ ID NO: 423812 - DNA, 30 bp, Artificial Sequence; identical to SEQ ID NO: 74939
  Description of Artificial Sequence: Synthetic oligonucleotide

SEQ ID NO: 423813 - DNA, 29 bp, Artificial Sequence
  Description of Artificial Sequence: Synthetic oligonucleotide
ctacggggttgtgaagagcttcacagtgc

SEQ ID NO: 423814 - DNA, 30 bp, Artificial Sequence; identical to SEQ ID NO: 74941
  Description of Artificial Sequence: Synthetic oligonucleotide

SEQ ID NO: 423815 - DNA, 29 bp, Artificial Sequence
  Description of Artificial Sequence: Synthetic oligonucleotide
acggggttgtgaagagcttcacagtgcag

SEQ ID NO: 423816 - DNA, 28 bp, Artificial Sequence
  Description of Artificial Sequence: Synthetic oligonucleotide
cggggttgtgaagagcttcacagtgcag

SEQ ID NO: 423817 - DNA, 28 bp, Artificial Sequence
  Description of Artificial Sequence: Synthetic oligonucleotide
ggggttgtgaagagcttcacagtgcagc

SEQ ID NO: 423818 - DNA, 28 bp, Artificial Sequence
  Description of Artificial Sequence: Synthetic oligonucleotide
gggttgtgaagagcttcacagtgcagcg

SEQ ID NO: 423819 - DNA, 28 bp, Artificial Sequence
  Description of Artificial Sequence: Synthetic oligonucleotide
ggttgtgaagagcttcacagtgcagcgg

SEQ ID NO: 423820 - DNA, 28 bp, Artificial Sequence
  Description of Artificial Sequence: Synthetic oligonucleotide
gttgtgaagagcttcacagtgcagcggc

SEQ ID NO: 423821 - DNA, 28 bp, Artificial Sequence
  Description of Artificial Sequence: Synthetic oligonucleotide
ttgtgaagagcttcacagtgcagcggcg

SEQ ID NO: 423822 - DNA, 27 bp, Artificial Sequence
  Description of Artificial Sequence: Synthetic oligonucleotide
tgtgaagagcttcacagtgcagcggcg

SEQ ID NO: 423823 - DNA, 27 bp, Artificial Sequence
  Description of Artificial Sequence: Synthetic oligonucleotide
gtgaagagcttcacagtgcagcggcga

SEQ ID NO: 423824 - DNA, 27 bp, Artificial Sequence
  Description of Artificial Sequence: Synthetic oligonucleotide
tgaagagcttcacagtgcagcggcgag

SEQ ID NO: 423825 - DNA, 29 bp, Artificial Sequence
  Description of Artificial Sequence: Synthetic oligonucleotide
atggtgtgtctgaagctccctggaggttc

SEQ ID NO: 423826 - DNA, 28 bp, Artificial Sequence
  Description of Artificial Sequence: Synthetic oligonucleotide
tggtgtgtctgaagctccctggaggttc

SEQ ID NO: 423827 - DNA, 27 bp, Artificial Sequence
  Description of Artificial Sequence: Synthetic oligonucleotide
ggtgtgtctgaagctccctggaggttc

SEQ ID NO: 423828 - DNA, 27 bp, Artificial Sequence
  Description of Artificial Sequence: Synthetic oligonucleotide
gtgtgtctgaagctccctggaggttcc

SEQ ID NO: 423829 - DNA, 29 bp, Artificial Sequence
  Description of Artificial Sequence: Synthetic oligonucleotide
tgtgtctgaagctccctggaggttcctac

SEQ ID NO: 423830 - DNA, 28 bp, Artificial Sequence
  Description of Artificial Sequence: Synthetic oligonucleotide
gtgtctgaagctccctggaggttcctac

SEQ ID NO: 423831 - DNA, 30 bp, Artificial Sequence; identical to SEQ ID NO: 74986
  Description of Artificial Sequence: Synthetic oligonucleotide

SEQ ID NO: 423832 - DNA, 29 bp, Artificial Sequence
  Description of Artificial Sequence: Synthetic oligonucleotide
gtctgaagctccctggaggttcctacatg

SEQ ID NO: 423833 - DNA, 29 bp, Artificial Sequence
  Description of Artificial Sequence: Synthetic oligonucleotide
tctgaagctccctggaggttcctacatgg

SEQ ID NO: 423834 - DNA, 28 bp, Artificial Sequence
  Description of Artificial Sequence: Synthetic oligonucleotide
ctgaagctccctggaggttcctacatgg

SEQ ID NO: 423835 - DNA, 28 bp, Artificial Sequence
  Description of Artificial Sequence: Synthetic oligonucleotide
tgaagctccctggaggttcctacatggc

SEQ ID NO: 423836 - DNA, 27 bp, Artificial Sequence
  Description of Artificial Sequence: Synthetic oligonucleotide
gaagctccctggaggttcctacatggc

SEQ ID NO: 423837 - DNA, 30 bp, Artificial Sequence; identical to SEQ ID NO: 74992
  Description of Artificial Sequence: Synthetic oligonucleotide

SEQ ID NO: 423838 - DNA, 29 bp, Artificial Sequence
  Description of Artificial Sequence: Synthetic oligonucleotide
agctccctggaggttcctacatggcaaag

SEQ ID NO: 423839 - DNA, 28 bp, Artificial Sequence
  Description of Artificial Sequence: Synthetic oligonucleotide
gctccctggaggttcctacatggcaaag

SEQ ID NO: 423840 - DNA, 28 bp, Artificial Sequence
  Description of Artificial Sequence: Synthetic oligonucleotide
ctccctggaggttcctacatggcaaagc

SEQ ID NO: 423841 - DNA, 29 bp, Artificial Sequence
  Description of Artificial Sequence: Synthetic oligonucleotide
tccctggaggttcctacatggcaaagctg

SEQ ID NO: 423842 - DNA, 28 bp, Artificial Sequence
  Description of Artificial Sequence: Synthetic oligonucleotide
ccctggaggttcctacatggcaaagctg

SEQ ID NO: 423843 - DNA, 29 bp, Artificial Sequence
  Description of Artificial Sequence: Synthetic oligonucleotide
cctggaggttcctacatggcaaagctgac

SEQ ID NO: 423844 - DNA, 30 bp, Artificial Sequence; identical to SEQ ID NO: 74999
  Description of Artificial Sequence: Synthetic oligonucleotide

SEQ ID NO: 423845 - DNA, 31 bp, Artificial Sequence; identical to SEQ ID NO: 75000
  Description of Artificial Sequence: Synthetic oligonucleotide

SEQ ID NO: 423846 - DNA, 30 bp, Artificial Sequence; identical to SEQ ID NO: 75001
  Description of Artificial Sequence: Synthetic oligonucleotide

SEQ ID NO: 423847 - DNA, 31 bp, Artificial Sequence; identical to SEQ ID NO: 75002
  Description of Artificial Sequence: Synthetic oligonucleotide

SEQ ID NO: 423848 - DNA, 32 bp, Artificial Sequence; identical to SEQ ID NO: 75003
  Description of Artificial Sequence: Synthetic oligonucleotide

SEQ ID NO: 423849 - DNA, 31 bp, Artificial Sequence; identical to SEQ ID NO: 75004
  Description of Artificial Sequence: Synthetic oligonucleotide

SEQ ID NO: 423850 - DNA, 32 bp, Artificial Sequence; identical to SEQ ID NO: 75005
  Description of Artificial Sequence: Synthetic oligonucleotide

SEQ ID NO: 423851 - DNA, 34 bp, Artificial Sequence; identical to SEQ ID NO: 75006
  Description of Artificial Sequence: Synthetic oligonucleotide

SEQ ID NO: 423852 - DNA, 33 bp, Artificial Sequence; identical to SEQ ID NO: 75007
  Description of Artificial Sequence: Synthetic oligonucleotide

SEQ ID NO: 423853 - DNA, 32 bp, Artificial Sequence; identical to SEQ ID NO: 75008
  Description of Artificial Sequence: Synthetic oligonucleotide

SEQ ID NO: 423854 - DNA, 32 bp, Artificial Sequence; identical to SEQ ID NO: 75009
  Description of Artificial Sequence: Synthetic oligonucleotide

SEQ ID NO: 423855 - DNA, 33 bp, Artificial Sequence; identical to SEQ ID NO: 75010
  Description of Artificial Sequence: Synthetic oligonucleotide

SEQ ID NO: 423856 - DNA, 32 bp, Artificial Sequence; identical to SEQ ID NO: 75011
  Description of Artificial Sequence: Synthetic oligonucleotide

SEQ ID NO: 423857 - DNA, 31 bp, Artificial Sequence; identical to SEQ ID NO: 75012
  Description of Artificial Sequence: Synthetic oligonucleotide

SEQ ID NO: 423858 - DNA, 31 bp, Artificial Sequence; identical to SEQ ID NO: 75013
  Description of Artificial Sequence: Synthetic oligonucleotide

SEQ ID NO: 423859 - DNA, 30 bp, Artificial Sequence; identical to SEQ ID NO: 75014
  Description of Artificial Sequence: Synthetic oligonucleotide

SEQ ID NO: 423860 - DNA, 29 bp, Artificial Sequence
  Description of Artificial Sequence: Synthetic oligonucleotide
ggcaaagctgacagtgacactgatggtgc

SEQ ID NO: 423861 - DNA, 30 bp, Artificial Sequence; identical to SEQ ID NO: 75016
  Description of Artificial Sequence: Synthetic oligonucleotide

SEQ ID NO: 423862 - DNA, 31 bp, Artificial Sequence; identical to SEQ ID NO: 75017
  Description of Artificial Sequence: Synthetic oligonucleotide

SEQ ID NO: 423863 - DNA, 31 bp, Artificial Sequence; identical to SEQ ID NO: 75018
  Description of Artificial Sequence: Synthetic oligonucleotide

SEQ ID NO: 423864 - DNA, 30 bp, Artificial Sequence; identical to SEQ ID NO: 75019
  Description of Artificial Sequence: Synthetic oligonucleotide

SEQ ID NO: 423865 - DNA, 29 bp, Artificial Sequence
  Description of Artificial Sequence: Synthetic oligonucleotide
agctgacagtgacactgatggtgctgagc

SEQ ID NO: 423866 - DNA, 27 bp, Artificial Sequence
  Description of Artificial Sequence: Synthetic oligonucleotide
tggggacacccgaccacgtttcttgca

SEQ ID NO: 423867 - DNA, 26 bp, Artificial Sequence
  Description of Artificial Sequence: Synthetic oligonucleotide
ggggacacccgaccacgtttcttgca

SEQ ID NO: 423868 - DNA, 26 bp, Artificial Sequence
  Description of Artificial Sequence: Synthetic oligonucleotide
gggacacccgaccacgtttcttgcag

SEQ ID NO: 423869 - DNA, 27 bp, Artificial Sequence
  Description of Artificial Sequence: Synthetic oligonucleotide
ggacacccgaccacgtttcttgcagca

SEQ ID NO: 423870 - DNA, 27 bp, Artificial Sequence
  Description of Artificial Sequence: Synthetic oligonucleotide
gacacccgaccacgtttcttgcagcag

SEQ ID NO: 423871 - DNA, 27 bp, Artificial Sequence
  Description of Artificial Sequence: Synthetic oligonucleotide
acacccgaccacgtttcttgcagcagg

SEQ ID NO: 423872 - DNA, 27 bp, Artificial Sequence
  Description of Artificial Sequence: Synthetic oligonucleotide
cacccgaccacgtttcttgcagcagga

SEQ ID NO: 423873 - DNA, 30 bp, Artificial Sequence; identical to SEQ ID NO: 75028
  Description of Artificial Sequence: Synthetic oligonucleotide

SEQ ID NO: 423874 - DNA, 29 bp, Artificial Sequence
  Description of Artificial Sequence: Synthetic oligonucleotide
cccgaccacgtttcttgcagcaggataag

SEQ ID NO: 423875 - DNA, 32 bp, Artificial Sequence; identical to SEQ ID NO: 75030
  Description of Artificial Sequence: Synthetic oligonucleotide

SEQ ID NO: 423876 - DNA, 33 bp, Artificial Sequence; identical to SEQ ID NO: 75031
  Description of Artificial Sequence: Synthetic oligonucleotide

SEQ ID NO: 423877 - DNA, 34 bp, Artificial Sequence; identical to SEQ ID NO: 75032
  Description of Artificial Sequence: Synthetic oligonucleotide

SEQ ID NO: 423878 - DNA, 35 bp, Artificial Sequence; identical to SEQ ID NO: 75033
  Description of Artificial Sequence: Synthetic oligonucleotide

SEQ ID NO: 423879 - DNA, 34 bp, Artificial Sequence; identical to SEQ ID NO: 75034
  Description of Artificial Sequence: Synthetic oligonucleotide

SEQ ID NO: 423880 - DNA, 23 bp, Artificial Sequence
  Description of Artificial Sequence: Synthetic oligonucleotide
acggagcgggtgcggttcctgca

SEQ ID NO: 423881 - DNA, 22 bp, Artificial Sequence
  Description of Artificial Sequence: Synthetic oligonucleotide
cggagcgggtgcggttcctgca

SEQ ID NO: 423882 - DNA, 23 bp, Artificial Sequence
  Description of Artificial Sequence: Synthetic oligonucleotide
ggagcgggtgcggttcctgcaca

SEQ ID NO: 423883 - DNA, 24 bp, Artificial Sequence
  Description of Artificial Sequence: Synthetic oligonucleotide
gagcgggtgcggttcctgcacaga

SEQ ID NO: 423884 - DNA, 25 bp, Artificial Sequence
  Description of Artificial Sequence: Synthetic oligonucleotide
agcgggtgcggttcctgcacagaga

SEQ ID NO: 423885 - DNA, 24 bp, Artificial Sequence
  Description of Artificial Sequence: Synthetic oligonucleotide
gcgggtgcggttcctgcacagaga

SEQ ID NO: 423886 - DNA, 26 bp, Artificial Sequence
  Description of Artificial Sequence: Synthetic oligonucleotide
cgggtgcggttcctgcacagagacat

SEQ ID NO: 423887 - DNA, 27 bp, Artificial Sequence
  Description of Artificial Sequence: Synthetic oligonucleotide
gggtgcggttcctgcacagagacatct

SEQ ID NO: 423888 - DNA, 31 bp, Artificial Sequence; identical to SEQ ID NO: 75043
  Description of Artificial Sequence: Synthetic oligonucleotide

SEQ ID NO: 423889 - DNA, 31 bp, Artificial Sequence; identical to SEQ ID NO: 75044
  Description of Artificial Sequence: Synthetic oligonucleotide

SEQ ID NO: 423890 - DNA, 33 bp, Artificial Sequence; identical to SEQ ID NO: 75045
  Description of Artificial Sequence: Synthetic oligonucleotide

SEQ ID NO: 423891 - DNA, 32 bp, Artificial Sequence; identical to SEQ ID NO: 75046
  Description of Artificial Sequence: Synthetic oligonucleotide

SEQ ID NO: 423892 - DNA, 33 bp, Artificial Sequence; identical to SEQ ID NO: 75047
  Description of Artificial Sequence: Synthetic oligonucleotide

SEQ ID NO: 423893 - DNA, 33 bp, Artificial Sequence; identical to SEQ ID NO: 75048
  Description of Artificial Sequence: Synthetic oligonucleotide

SEQ ID NO: 423894 - DNA, 34 bp, Artificial Sequence; identical to SEQ ID NO: 75049
  Description of Artificial Sequence: Synthetic oligonucleotide

SEQ ID NO: 423895 - DNA, 34 bp, Artificial Sequence; identical to SEQ ID NO: 75050
  Description of Artificial Sequence: Synthetic oligonucleotide

SEQ ID NO: 423896 - DNA, 33 bp, Artificial Sequence; identical to SEQ ID NO: 75051
  Description of Artificial Sequence: Synthetic oligonucleotide

SEQ ID NO: 423897 - DNA, 32 bp, Artificial Sequence; identical to SEQ ID NO: 75052
  Description of Artificial Sequence: Synthetic oligonucleotide

SEQ ID NO: 423898 - DNA, 33 bp, Artificial Sequence; identical to SEQ ID NO: 75053
  Description of Artificial Sequence: Synthetic oligonucleotide

SEQ ID NO: 423899 - DNA, 35 bp, Artificial Sequence; identical to SEQ ID NO: 75054
  Description of Artificial Sequence: Synthetic oligonucleotide

SEQ ID NO: 423900 - DNA, 34 bp, Artificial Sequence; identical to SEQ ID NO: 75055
  Description of Artificial Sequence: Synthetic oligonucleotide

SEQ ID NO: 423901 - DNA, 34 bp, Artificial Sequence; identical to SEQ ID NO: 75056
  Description of Artificial Sequence: Synthetic oligonucleotide

SEQ ID NO: 423902 - DNA, 34 bp, Artificial Sequence; identical to SEQ ID NO: 75057
  Description of Artificial Sequence: Synthetic oligonucleotide

SEQ ID NO: 423903 - DNA, 33 bp, Artificial Sequence; identical to SEQ ID NO: 75058
  Description of Artificial Sequence: Synthetic oligonucleotide

SEQ ID NO: 423904 - DNA, 33 bp, Artificial Sequence; identical to SEQ ID NO: 75059
  Description of Artificial Sequence: Synthetic oligonucleotide

SEQ ID NO: 423905 - DNA, 32 bp, Artificial Sequence; identical to SEQ ID NO: 75060
  Description of Artificial Sequence: Synthetic oligonucleotide

SEQ ID NO: 423906 - DNA, 34 bp, Artificial Sequence; identical to SEQ ID NO: 75061
  Description of Artificial Sequence: Synthetic oligonucleotide

SEQ ID NO: 423907 - DNA, 33 bp, Artificial Sequence; identical to SEQ ID NO: 75062
  Description of Artificial Sequence: Synthetic oligonucleotide

SEQ ID NO: 423908 - DNA, 33 bp, Artificial Sequence; identical to SEQ ID NO: 75063
  Description of Artificial Sequence: Synthetic oligonucleotide

SEQ ID NO: 423909 - DNA, 32 bp, Artificial Sequence; identical to SEQ ID NO: 75064
  Description of Artificial Sequence: Synthetic oligonucleotide

SEQ ID NO: 423910 - DNA, 33 bp, Artificial Sequence; identical to SEQ ID NO: 75065
  Description of Artificial Sequence: Synthetic oligonucleotide

SEQ ID NO: 423911 - DNA, 31 bp, Artificial Sequence; identical to SEQ ID NO: 75066
  Description of Artificial Sequence: Synthetic oligonucleotide

SEQ ID NO: 423912 - DNA, 31 bp, Artificial Sequence; identical to SEQ ID NO: 75067
  Description of Artificial Sequence: Synthetic oligonucleotide

SEQ ID NO: 423913 - DNA, 33 bp, Artificial Sequence; identical to SEQ ID NO: 75068
  Description of Artificial Sequence: Synthetic oligonucleotide

SEQ ID NO: 423914 - DNA, 32 bp, Artificial Sequence; identical to SEQ ID NO: 75069
  Description of Artificial Sequence: Synthetic oligonucleotide

SEQ ID NO: 423915 - DNA, 32 bp, Artificial Sequence; identical to SEQ ID NO: 75070
  Description of Artificial Sequence: Synthetic oligonucleotide

SEQ ID NO: 423916 - DNA, 31 bp, Artificial Sequence; identical to SEQ ID NO: 75071
  Description of Artificial Sequence: Synthetic oligonucleotide

SEQ ID NO: 423917 - DNA, 30 bp, Artificial Sequence; identical to SEQ ID NO: 75072
  Description of Artificial Sequence: Synthetic oligonucleotide

SEQ ID NO: 423918 - DNA, 31 bp, Artificial Sequence; identical to SEQ ID NO: 75073
  Description of Artificial Sequence: Synthetic oligonucleotide

SEQ ID NO: 423919 - DNA, 30 bp, Artificial Sequence; identical to SEQ ID NO: 75074
  Description of Artificial Sequence: Synthetic oligonucleotide

SEQ ID NO: 423920 - DNA, 30 bp, Artificial Sequence; identical to SEQ ID NO: 75075
  Description of Artificial Sequence: Synthetic oligonucleotide

SEQ ID NO: 423921 - DNA, 30 bp, Artificial Sequence; identical to SEQ ID NO: 75076
  Description of Artificial Sequence: Synthetic oligonucleotide

SEQ ID NO: 423922 - DNA, 31 bp, Artificial Sequence; identical to SEQ ID NO: 75077
  Description of Artificial Sequence: Synthetic oligonucleotide

SEQ ID NO: 423923 - DNA, 30 bp, Artificial Sequence; identical to SEQ ID NO: 75078
  Description of Artificial Sequence: Synthetic oligonucleotide

SEQ ID NO: 423924 - DNA, 29 bp, Artificial Sequence
  Description of Artificial Sequence: Synthetic oligonucleotide
aggtgactgtgtatcctgcaaggacccag

SEQ ID NO: 423925 - DNA, 28 bp, Artificial Sequence
  Description of Artificial Sequence: Synthetic oligonucleotide
ggtgactgtgtatcctgcaaggacccag

SEQ ID NO: 423926 - DNA, 29 bp, Artificial Sequence
  Description of Artificial Sequence: Synthetic oligonucleotide
gtgactgtgtatcctgcaaggacccagac

SEQ ID NO: 423927 - DNA, 29 bp, Artificial Sequence
  Description of Artificial Sequence: Synthetic oligonucleotide
tgactgtgtatcctgcaaggacccagacc

SEQ ID NO: 423928 - DNA, 28 bp, Artificial Sequence
  Description of Artificial Sequence: Synthetic oligonucleotide
gactgtgtatcctgcaaggacccagacc

SEQ ID NO: 423929 - DNA, 28 bp, Artificial Sequence
  Description of Artificial Sequence: Synthetic oligonucleotide
actgtgtatcctgcaaggacccagaccc

SEQ ID NO: 423930 - DNA, 27 bp, Artificial Sequence
  Description of Artificial Sequence: Synthetic oligonucleotide
ctgtgtatcctgcaaggacccagaccc

SEQ ID NO: 423931 - DNA, 28 bp, Artificial Sequence
  Description of Artificial Sequence: Synthetic oligonucleotide
tgtgtatcctgcaaggacccagaccctg

SEQ ID NO: 423932 - DNA, 27 bp, Artificial Sequence
  Description of Artificial Sequence: Synthetic oligonucleotide
gtgtatcctgcaaggacccagaccctg

SEQ ID NO: 423933 - DNA, 27 bp, Artificial Sequence
  Description of Artificial Sequence: Synthetic oligonucleotide
tgtatcctgcaaggacccagaccctgc

SEQ ID NO: 423934 - DNA, 27 bp, Artificial Sequence
  Description of Artificial Sequence: Synthetic oligonucleotide
gtatcctgcaaggacccagaccctgca

SEQ ID NO: 423935 - DNA, 27 bp, Artificial Sequence
  Description of Artificial Sequence: Synthetic oligonucleotide
tatcctgcaaggacccagaccctgcag

SEQ ID NO: 423936 - DNA, 26 bp, Artificial Sequence
  Description of Artificial Sequence: Synthetic oligonucleotide
atcctgcaaggacccagaccctgcag

SEQ ID NO: 423937 - DNA, 25 bp, Artificial Sequence
  Description of Artificial Sequence: Synthetic oligonucleotide
tcctgcaaggacccagaccctgcag

SEQ ID NO: 423938 - DNA, 24 bp, Artificial Sequence
  Description of Artificial Sequence: Synthetic oligonucleotide
cctgcaaggacccagaccctgcag

SEQ ID NO: 423939 - DNA, 25 bp, Artificial Sequence
  Description of Artificial Sequence: Synthetic oligonucleotide
ctgcaaggacccagaccctgcagca

SEQ ID NO: 423940 - DNA, 25 bp, Artificial Sequence
  Description of Artificial Sequence: Synthetic oligonucleotide
tgcaaggacccagaccctgcagcac

SEQ ID NO: 423941 - DNA, 24 bp, Artificial Sequence
  Description of Artificial Sequence: Synthetic oligonucleotide
gcaaggacccagaccctgcagcac

SEQ ID NO: 423942 - DNA, 25 bp, Artificial Sequence
  Description of Artificial Sequence: Synthetic oligonucleotide
caaggacccagaccctgcagcacca

SEQ ID NO: 423943 - DNA, 27 bp, Artificial Sequence
  Description of Artificial Sequence: Synthetic oligonucleotide
aaggacccagaccctgcagcaccacaa

SEQ ID NO: 423944 - DNA, 26 bp, Artificial Sequence
  Description of Artificial Sequence: Synthetic oligonucleotide
aggacccagaccctgcagcaccacaa

SEQ ID NO: 423945 - DNA, 25 bp, Artificial Sequence
  Description of Artificial Sequence: Synthetic oligonucleotide
ggacccagaccctgcagcaccacaa

SEQ ID NO: 423946 - DNA, 25 bp, Artificial Sequence
  Description of Artificial Sequence: Synthetic oligonucleotide
gacccagaccctgcagcaccacaac

SEQ ID NO: 423947 - DNA, 26 bp, Artificial Sequence
  Description of Artificial Sequence: Synthetic oligonucleotide
acccagaccctgcagcaccacaacct

SEQ ID NO: 423948 - DNA, 25 bp, Artificial Sequence
  Description of Artificial Sequence: Synthetic oligonucleotide
cccagaccctgcagcaccacaacct

SEQ ID NO: 423949 - DNA, 25 bp, Artificial Sequence
  Description of Artificial Sequence: Synthetic oligonucleotide
ccagaccctgcagcaccacaacctc

SEQ ID NO: 423950 - DNA, 26 bp, Artificial Sequence
  Description of Artificial Sequence: Synthetic oligonucleotide
cagaccctgcagcaccacaacctcct

SEQ ID NO: 423951 - DNA, 26 bp, Artificial Sequence
  Description of Artificial Sequence: Synthetic oligonucleotide
agaccctgcagcaccacaacctcctg

SEQ ID NO: 423952 - DNA, 25 bp, Artificial Sequence
  Description of Artificial Sequence: Synthetic oligonucleotide
gaccctgcagcaccacaacctcctg

SEQ ID NO: 423953 - DNA, 26 bp, Artificial Sequence
  Description of Artificial Sequence: Synthetic oligonucleotide
accctgcagcaccacaacctcctggt

SEQ ID NO: 423954 - DNA, 26 bp, Artificial Sequence
  Description of Artificial Sequence: Synthetic oligonucleotide
ctggggtggtgtccacaggcctgatt

SEQ ID NO: 423955 - DNA, 27 bp, Artificial Sequence
  Description of Artificial Sequence: Synthetic oligonucleotide
tggggtggtgtccacaggcctgattca

SEQ ID NO: 423956 - DNA, 26 bp, Artificial Sequence
  Description of Artificial Sequence: Synthetic oligonucleotide
ggggtggtgtccacaggcctgattca

SEQ ID NO: 423957 - DNA, 27 bp, Artificial Sequence
  Description of Artificial Sequence: Synthetic oligonucleotide
gggtggtgtccacaggcctgattcaga

SEQ ID NO: 423958 - DNA, 29 bp, Artificial Sequence
  Description of Artificial Sequence: Synthetic oligonucleotide
ggtggtgtccacaggcctgattcagaatg

SEQ ID NO: 423959 - DNA, 29 bp, Artificial Sequence
  Description of Artificial Sequence: Synthetic oligonucleotide
gtggtgtccacaggcctgattcagaatgg

SEQ ID NO: 423960 - DNA, 30 bp, Artificial Sequence; identical to SEQ ID NO: 75115
  Description of Artificial Sequence: Synthetic oligonucleotide

SEQ ID NO: 423961 - DNA, 29 bp, Artificial Sequence
  Description of Artificial Sequence: Synthetic oligonucleotide
ggtgtccacaggcctgattcagaatggag

SEQ ID NO: 423962 - DNA, 30 bp, Artificial Sequence; identical to SEQ ID NO: 75117
  Description of Artificial Sequence: Synthetic oligonucleotide

SEQ ID NO: 423963 - DNA, 31 bp, Artificial Sequence; identical to SEQ ID NO: 75118
  Description of Artificial Sequence: Synthetic oligonucleotide

SEQ ID NO: 423964 - DNA, 30 bp, Artificial Sequence; identical to SEQ ID NO: 75119
  Description of Artificial Sequence: Synthetic oligonucleotide

SEQ ID NO: 423965 - DNA, 30 bp, Artificial Sequence; identical to SEQ ID NO: 75120
  Description of Artificial Sequence: Synthetic oligonucleotide

SEQ ID NO: 423966 - DNA, 29 bp, Artificial Sequence
  Description of Artificial Sequence: Synthetic oligonucleotide
ccacaggcctgattcagaatggagactgg

SEQ ID NO: 423967 - DNA, 30 bp, Artificial Sequence; identical to SEQ ID NO: 75122
  Description of Artificial Sequence: Synthetic oligonucleotide

SEQ ID NO: 423968 - DNA, 30 bp, Artificial Sequence; identical to SEQ ID NO: 75123
  Description of Artificial Sequence: Synthetic oligonucleotide

SEQ ID NO: 423969 - DNA, 29 bp, Artificial Sequence
  Description of Artificial Sequence: Synthetic oligonucleotide
caggcctgattcagaatggagactggacc

SEQ ID NO: 423970 - DNA, 31 bp, Artificial Sequence; identical to SEQ ID NO: 75125
  Description of Artificial Sequence: Synthetic oligonucleotide

SEQ ID NO: 423971 - DNA, 30 bp, Artificial Sequence; identical to SEQ ID NO: 75126
  Description of Artificial Sequence: Synthetic oligonucleotide

SEQ ID NO: 423972 - DNA, 30 bp, Artificial Sequence; identical to SEQ ID NO: 75127
  Description of Artificial Sequence: Synthetic oligonucleotide

SEQ ID NO: 423973 - DNA, 31 bp, Artificial Sequence; identical to SEQ ID NO: 75128
  Description of Artificial Sequence: Synthetic oligonucleotide

SEQ ID NO: 423974 - DNA, 32 bp, Artificial Sequence; identical to SEQ ID NO: 75129
  Description of Artificial Sequence: Synthetic oligonucleotide

SEQ ID NO: 423975 - DNA, 32 bp, Artificial Sequence; identical to SEQ ID NO: 75130
  Description of Artificial Sequence: Synthetic oligonucleotide

SEQ ID NO: 423976 - DNA, 31 bp, Artificial Sequence; identical to SEQ ID NO: 75131
  Description of Artificial Sequence: Synthetic oligonucleotide

SEQ ID NO: 423977 - DNA, 31 bp, Artificial Sequence; identical to SEQ ID NO: 75132
  Description of Artificial Sequence: Synthetic oligonucleotide

SEQ ID NO: 423978 - DNA, 30 bp, Artificial Sequence; identical to SEQ ID NO: 75133
  Description of Artificial Sequence: Synthetic oligonucleotide

SEQ ID NO: 423979 - DNA, 29 bp, Artificial Sequence
  Description of Artificial Sequence: Synthetic oligonucleotide
tcagaatggagactggaccttccagaccc

SEQ ID NO: 423980 - DNA, 28 bp, Artificial Sequence
  Description of Artificial Sequence: Synthetic oligonucleotide
ccctctcacagtggaatggagagcacag

SEQ ID NO: 423981 - DNA, 29 bp, Artificial Sequence
  Description of Artificial Sequence: Synthetic oligonucleotide
cctctcacagtggaatggagagcacagtc

SEQ ID NO: 423982 - DNA, 30 bp, Artificial Sequence; identical to SEQ ID NO: 75158
  Description of Artificial Sequence: Synthetic oligonucleotide

SEQ ID NO: 423983 - DNA, 33 bp, Artificial Sequence; identical to SEQ ID NO: 75159
  Description of Artificial Sequence: Synthetic oligonucleotide

SEQ ID NO: 423984 - DNA, 32 bp, Artificial Sequence; identical to SEQ ID NO: 75160
  Description of Artificial Sequence: Synthetic oligonucleotide

SEQ ID NO: 423985 - DNA, 33 bp, Artificial Sequence; identical to SEQ ID NO: 75161
  Description of Artificial Sequence: Synthetic oligonucleotide

SEQ ID NO: 423986 - DNA, 32 bp, Artificial Sequence; identical to SEQ ID NO: 75162
  Description of Artificial Sequence: Synthetic oligonucleotide

SEQ ID NO: 423987 - DNA, 32 bp, Artificial Sequence; identical to SEQ ID NO: 75163
  Description of Artificial Sequence: Synthetic oligonucleotide

SEQ ID NO: 423988 - DNA, 31 bp, Artificial Sequence; identical to SEQ ID NO: 75164
  Description of Artificial Sequence: Synthetic oligonucleotide

SEQ ID NO: 423989 - DNA, 32 bp, Artificial Sequence; identical to SEQ ID NO: 75165
  Description of Artificial Sequence: Synthetic oligonucleotide

SEQ ID NO: 423990 - DNA, 31 bp, Artificial Sequence; identical to SEQ ID NO: 75166
  Description of Artificial Sequence: Synthetic oligonucleotide

SEQ ID NO: 423991 - DNA, 32 bp, Artificial Sequence; identical to SEQ ID NO: 75167
  Description of Artificial Sequence: Synthetic oligonucleotide

SEQ ID NO: 423992 - DNA, 31 bp, Artificial Sequence; identical to SEQ ID NO: 75168
  Description of Artificial Sequence: Synthetic oligonucleotide

SEQ ID NO: 423993 - DNA, 32 bp, Artificial Sequence; identical to SEQ ID NO: 75169
  Description of Artificial Sequence: Synthetic oligonucleotide

SEQ ID NO: 423994 - DNA, 32 bp, Artificial Sequence; identical to SEQ ID NO: 75170
  Description of Artificial Sequence: Synthetic oligonucleotide

SEQ ID NO: 423995 - DNA, 31 bp, Artificial Sequence; identical to SEQ ID NO: 75171
  Description of Artificial Sequence: Synthetic oligonucleotide

SEQ ID NO: 423996 - DNA, 30 bp, Artificial Sequence; identical to SEQ ID NO: 75172
  Description of Artificial Sequence: Synthetic oligonucleotide

SEQ ID NO: 423997 - DNA, 29 bp, Artificial Sequence
  Description of Artificial Sequence: Synthetic oligonucleotide
ggagagcacagtctgaatctgcacagagc

SEQ ID NO: 423998 - DNA, 31 bp, Artificial Sequence; identical to SEQ ID NO: 75174
  Description of Artificial Sequence: Synthetic oligonucleotide

SEQ ID NO: 423999 - DNA, 33 bp, Artificial Sequence; identical to SEQ ID NO: 75175
  Description of Artificial Sequence: Synthetic oligonucleotide

SEQ ID NO: 424000 - DNA, 32 bp, Artificial Sequence; identical to SEQ ID NO: 75176
  Description of Artificial Sequence: Synthetic oligonucleotide

SEQ ID NO: 424001 - DNA, 32 bp, Artificial Sequence; identical to SEQ ID NO: 75177
  Description of Artificial Sequence: Synthetic oligonucleotide

SEQ ID NO: 424002 - DNA, 31 bp, Artificial Sequence; identical to SEQ ID NO: 75178
  Description of Artificial Sequence: Synthetic oligonucleotide

SEQ ID NO: 424003 - DNA, 32 bp, Artificial Sequence; identical to SEQ ID NO: 75179
  Description of Artificial Sequence: Synthetic oligonucleotide

SEQ ID NO: 424004 - DNA, 33 bp, Artificial Sequence; identical to SEQ ID NO: 75180
  Description of Artificial Sequence: Synthetic oligonucleotide

SEQ ID NO: 424005 - DNA, 32 bp, Artificial Sequence; identical to SEQ ID NO: 75181
  Description of Artificial Sequence: Synthetic oligonucleotide

SEQ ID NO: 424006 - DNA, 33 bp, Artificial Sequence; identical to SEQ ID NO: 75182
  Description of Artificial Sequence: Synthetic oligonucleotide

SEQ ID NO: 424007 - DNA, 26 bp, Artificial Sequence
  Description of Artificial Sequence: Synthetic oligonucleotide
ctgctcttccttggggccgggctatt

SEQ ID NO: 424008 - DNA, 27 bp, Artificial Sequence
  Description of Artificial Sequence: Synthetic oligonucleotide
tgctcttccttggggccgggctattca

SEQ ID NO: 424009 - DNA, 27 bp, Artificial Sequence
  Description of Artificial Sequence: Synthetic oligonucleotide
gctcttccttggggccgggctattcat

SEQ ID NO: 424010 - DNA, 27 bp, Artificial Sequence
  Description of Artificial Sequence: Synthetic oligonucleotide
ctcttccttggggccgggctattcatc

SEQ ID NO: 424011 - DNA, 29 bp, Artificial Sequence
  Description of Artificial Sequence: Synthetic oligonucleotide
tcttccttggggccgggctattcatctac

SEQ ID NO: 424012 - DNA, 28 bp, Artificial Sequence
  Description of Artificial Sequence: Synthetic oligonucleotide
cttccttggggccgggctattcatctac

SEQ ID NO: 424013 - DNA, 30 bp, Artificial Sequence; identical to SEQ ID NO: 75189
  Description of Artificial Sequence: Synthetic oligonucleotide

SEQ ID NO: 424014 - DNA, 29 bp, Artificial Sequence
  Description of Artificial Sequence: Synthetic oligonucleotide
tccttggggccgggctattcatctacttc

SEQ ID NO: 424015 - DNA, 28 bp, Artificial Sequence
  Description of Artificial Sequence: Synthetic oligonucleotide
ccttggggccgggctattcatctacttc

SEQ ID NO: 424016 - DNA, 30 bp, Artificial Sequence; identical to SEQ ID NO: 75192
  Description of Artificial Sequence: Synthetic oligonucleotide

SEQ ID NO: 424017 - DNA, 33 bp, Artificial Sequence; identical to SEQ ID NO: 75193
  Description of Artificial Sequence: Synthetic oligonucleotide

SEQ ID NO: 424018 - DNA, 32 bp, Artificial Sequence; identical to SEQ ID NO: 75194
  Description of Artificial Sequence: Synthetic oligonucleotide

SEQ ID NO: 424019 - DNA, 31 bp, Artificial Sequence; identical to SEQ ID NO: 75195
  Description of Artificial Sequence: Synthetic oligonucleotide

SEQ ID NO: 424020 - DNA, 32 bp, Artificial Sequence; identical to SEQ ID NO: 75196
  Description of Artificial Sequence: Synthetic oligonucleotide

SEQ ID NO: 424021 - DNA, 35 bp, Artificial Sequence; identical to SEQ ID NO: 75197
  Description of Artificial Sequence: Synthetic oligonucleotide

SEQ ID NO: 424022 - DNA, 35 bp, Artificial Sequence; identical to SEQ ID NO: 75198
  Description of Artificial Sequence: Synthetic oligonucleotide

SEQ ID NO: 424023 - DNA, 35 bp, Artificial Sequence; identical to SEQ ID NO: 75199
  Description of Artificial Sequence: Synthetic oligonucleotide

SEQ ID NO: 424024 - DNA, 35 bp, Artificial Sequence; identical to SEQ ID NO: 75200
  Description of Artificial Sequence: Synthetic oligonucleotide

SEQ ID NO: 424025 - DNA, 36 bp, Artificial Sequence; identical to SEQ ID NO: 75201
  Description of Artificial Sequence: Synthetic oligonucleotide

SEQ ID NO: 424026 - DNA, 37 bp, Artificial Sequence; identical to SEQ ID NO: 75202
  Description of Artificial Sequence: Synthetic oligonucleotide

SEQ ID NO: 424027 - DNA, 38 bp, Artificial Sequence; identical to SEQ ID NO: 75203
  Description of Artificial Sequence: Synthetic oligonucleotide

SEQ ID NO: 424028 - DNA, 38 bp, Artificial Sequence; identical to SEQ ID NO: 75204
  Description of Artificial Sequence: Synthetic oligonucleotide

SEQ ID NO: 424029 - DNA, 39 bp, Artificial Sequence; identical to SEQ ID NO: 75205
  Description of Artificial Sequence: Synthetic oligonucleotide

SEQ ID NO: 424030 - DNA, 38 bp, Artificial Sequence; identical to SEQ ID NO: 75206
  Description of Artificial Sequence: Synthetic oligonucleotide

SEQ ID NO: 424031 - DNA, 37 bp, Artificial Sequence; identical to SEQ ID NO: 75207
  Description of Artificial Sequence: Synthetic oligonucleotide

SEQ ID NO: 424032 - DNA, 36 bp, Artificial Sequence; identical to SEQ ID NO: 75208
  Description of Artificial Sequence: Synthetic oligonucleotide

SEQ ID NO: 424033 - DNA, 35 bp, Artificial Sequence; identical to SEQ ID NO: 75209
  Description of Artificial Sequence: Synthetic oligonucleotide

SEQ ID NO: 424034 - DNA, 37 bp, Artificial Sequence; identical to SEQ ID NO: 75210
  Description of Artificial Sequence: Synthetic oligonucleotide

SEQ ID NO: 424035 - DNA, 36 bp, Artificial Sequence; identical to SEQ ID NO: 75211
  Description of Artificial Sequence: Synthetic oligonucleotide

SEQ ID NO: 424036 - DNA, 35 bp, Artificial Sequence; identical to SEQ ID NO: 75212
  Description of Artificial Sequence: Synthetic oligonucleotide

SEQ ID NO: 424037 - DNA, 36 bp, Artificial Sequence; identical to SEQ ID NO: 75213
  Description of Artificial Sequence: Synthetic oligonucleotide

SEQ ID NO: 424038 - DNA, 35 bp, Artificial Sequence; identical to SEQ ID NO: 75214
  Description of Artificial Sequence: Synthetic oligonucleotide

SEQ ID NO: 424039 - DNA, 34 bp, Artificial Sequence; identical to SEQ ID NO: 75215
  Description of Artificial Sequence: Synthetic oligonucleotide

SEQ ID NO: 424040 - DNA, 34 bp, Artificial Sequence; identical to SEQ ID NO: 75216
  Description of Artificial Sequence: Synthetic oligonucleotide

SEQ ID NO: 424041 - DNA, 33 bp, Artificial Sequence; identical to SEQ ID NO: 75217
  Description of Artificial Sequence: Synthetic oligonucleotide

SEQ ID NO: 424042 - DNA, 32 bp, Artificial Sequence; identical to SEQ ID NO: 75218
  Description of Artificial Sequence: Synthetic oligonucleotide

SEQ ID NO: 424043 - DNA, 32 bp, Artificial Sequence; identical to SEQ ID NO: 75219
  Description of Artificial Sequence: Synthetic oligonucleotide

SEQ ID NO: 424044 - DNA, 31 bp, Artificial Sequence; identical to SEQ ID NO: 75220
  Description of Artificial Sequence: Synthetic oligonucleotide

SEQ ID NO: 424045 - DNA, 30 bp, Artificial Sequence; identical to SEQ ID NO: 75221
  Description of Artificial Sequence: Synthetic oligonucleotide

SEQ ID NO: 424046 - DNA, 32 bp, Artificial Sequence; identical to SEQ ID NO: 75222
  Description of Artificial Sequence: Synthetic oligonucleotide

SEQ ID NO: 424047 - DNA, 31 bp, Artificial Sequence; identical to SEQ ID NO: 75223
  Description of Artificial Sequence: Synthetic oligonucleotide

SEQ ID NO: 424048 - DNA, 30 bp, Artificial Sequence; identical to SEQ ID NO: 75224
  Description of Artificial Sequence: Synthetic oligonucleotide

SEQ ID NO: 424049 - DNA, 29 bp, Artificial Sequence
  Description of Artificial Sequence: Synthetic oligonucleotide
cagaaagggcactctggacttcacccaac

SEQ ID NO: 424050 - DNA, 30 bp, Artificial Sequence; identical to SEQ ID NO: 75226
  Description of Artificial Sequence: Synthetic oligonucleotide

SEQ ID NO: 424051 - DNA, 29 bp, Artificial Sequence
  Description of Artificial Sequence: Synthetic oligonucleotide
gaaagggcactctggacttcacccaacag

SEQ ID NO: 424052 - DNA, 29 bp, Artificial Sequence
  Description of Artificial Sequence: Synthetic oligonucleotide
aaagggcactctggacttcacccaacagg

SEQ ID NO: 424053 - DNA, 28 bp, Artificial Sequence
  Description of Artificial Sequence: Synthetic oligonucleotide
aagggcactctggacttcacccaacagg

SEQ ID NO: 424054 - DNA, 27 bp, Artificial Sequence
  Description of Artificial Sequence: Synthetic oligonucleotide
agggcactctggacttcacccaacagg

SEQ ID NO: 424055 - DNA, 27 bp, Artificial Sequence
  Description of Artificial Sequence: Synthetic oligonucleotide
gggcactctggacttcacccaacagga

SEQ ID NO: 424056 - DNA, 27 bp, Artificial Sequence
  Description of Artificial Sequence: Synthetic oligonucleotide
ggcactctggacttcacccaacaggac

SEQ ID NO: 424057 - DNA, 28 bp, Artificial Sequence
  Description of Artificial Sequence: Synthetic oligonucleotide
gcactctggacttcacccaacaggactc

SEQ ID NO: 424058 - DNA, 28 bp, Artificial Sequence
  Description of Artificial Sequence: Synthetic oligonucleotide
cactctggacttcacccaacaggactcg

SEQ ID NO: 424059 - DNA, 29 bp, Artificial Sequence
  Description of Artificial Sequence: Synthetic oligonucleotide
actctggacttcacccaacaggactcgtg

SEQ ID NO: 424060 - DNA, 28 bp, Artificial Sequence
  Description of Artificial Sequence: Synthetic oligonucleotide
ctctggacttcacccaacaggactcgtg

SEQ ID NO: 424061 - DNA, 29 bp, Artificial Sequence
  Description of Artificial Sequence: Synthetic oligonucleotide
tctggacttcacccaacaggactcgtgag

SEQ ID NO: 424062 - DNA, 28 bp, Artificial Sequence
  Description of Artificial Sequence: Synthetic oligonucleotide
ctggacttcacccaacaggactcgtgag

SEQ ID NO: 424063 - DNA, 28 bp, Artificial Sequence
  Description of Artificial Sequence: Synthetic oligonucleotide
tggacttcacccaacaggactcgtgagc

SEQ ID NO: 424064 - DNA, 27 bp, Artificial Sequence
  Description of Artificial Sequence: Synthetic oligonucleotide
ggacttcacccaacaggactcgtgagc

SEQ ID NO: 424065 - DNA, 28 bp, Artificial Sequence
  Description of Artificial Sequence: Synthetic oligonucleotide
gacttcacccaacaggactcgtgagctg

SEQ ID NO: 424066 - DNA, 24 bp, Artificial Sequence
  Description of Artificial Sequence: Synthetic oligonucleotide
agcgggtgcggttcctgcacagag

SEQ ID NO: 424067 - DNA, 23 bp, Artificial Sequence
  Description of Artificial Sequence: Synthetic oligonucleotide
gcgggtgcggttcctgcacagag

SEQ ID NO: 424068 - DNA, 23 bp, Artificial Sequence
  Description of Artificial Sequence: Synthetic oligonucleotide
cgggtgcggttcctgcacagagg

SEQ ID NO: 424069 - DNA, 25 bp, Artificial Sequence
  Description of Artificial Sequence: Synthetic oligonucleotide
gggtgcggttcctgcacagaggcat

SEQ ID NO: 424070 - DNA, 27 bp, Artificial Sequence
  Description of Artificial Sequence: Synthetic oligonucleotide
ggtgcggttcctgcacagaggcatcta

SEQ ID NO: 424071 - DNA, 30 bp, Artificial Sequence; identical to SEQ ID NO: 75247
  Description of Artificial Sequence: Synthetic oligonucleotide

SEQ ID NO: 424072 - DNA, 30 bp, Artificial Sequence; identical to SEQ ID NO: 75248
  Description of Artificial Sequence: Synthetic oligonucleotide

SEQ ID NO: 424073 - DNA, 29 bp, Artificial Sequence
  Description of Artificial Sequence: Synthetic oligonucleotide
gcggttcctgcacagaggcatctataacc

SEQ ID NO: 424074 - DNA, 31 bp, Artificial Sequence; identical to SEQ ID NO: 75250
  Description of Artificial Sequence: Synthetic oligonucleotide

SEQ ID NO: 424075 - DNA, 32 bp, Artificial Sequence; identical to SEQ ID NO: 75251
  Description of Artificial Sequence: Synthetic oligonucleotide

SEQ ID NO: 424076 - DNA, 32 bp, Artificial Sequence; identical to SEQ ID NO: 75252
  Description of Artificial Sequence: Synthetic oligonucleotide

SEQ ID NO: 424077 - DNA, 33 bp, Artificial Sequence; identical to SEQ ID NO: 75253
  Description of Artificial Sequence: Synthetic oligonucleotide

SEQ ID NO: 424078 - DNA, 32 bp, Artificial Sequence; identical to SEQ ID NO: 75254
  Description of Artificial Sequence: Synthetic oligonucleotide

SEQ ID NO: 424079 - DNA, 31 bp, Artificial Sequence; identical to SEQ ID NO: 75255
  Description of Artificial Sequence: Synthetic oligonucleotide

SEQ ID NO: 424080 - DNA, 30 bp, Artificial Sequence; identical to SEQ ID NO: 75256
  Description of Artificial Sequence: Synthetic oligonucleotide

SEQ ID NO: 424081 - DNA, 30 bp, Artificial Sequence; identical to SEQ ID NO: 75257
  Description of Artificial Sequence: Synthetic oligonucleotide

SEQ ID NO: 424082 - DNA, 29 bp, Artificial Sequence
  Description of Artificial Sequence: Synthetic oligonucleotide
acagccagaaggacttcctggaagacacg

SEQ ID NO: 424083 - DNA, 28 bp, Artificial Sequence
  Description of Artificial Sequence: Synthetic oligonucleotide
cagccagaaggacttcctggaagacacg

SEQ ID NO: 424084 - DNA, 28 bp, Artificial Sequence
  Description of Artificial Sequence: Synthetic oligonucleotide
agccagaaggacttcctggaagacacgc

SEQ ID NO: 424085 - DNA, 27 bp, Artificial Sequence
  Description of Artificial Sequence: Synthetic oligonucleotide
gccagaaggacttcctggaagacacgc

SEQ ID NO: 424086 - DNA, 27 bp, Artificial Sequence
  Description of Artificial Sequence: Synthetic oligonucleotide
ccagaaggacttcctggaagacacgcg

SEQ ID NO: 424087 - DNA, 27 bp, Artificial Sequence
  Description of Artificial Sequence: Synthetic oligonucleotide
cagaaggacttcctggaagacacgcgc

SEQ ID NO: 424088 - DNA, 27 bp, Artificial Sequence
  Description of Artificial Sequence: Synthetic oligonucleotide
agaaggacttcctggaagacacgcgcg

SEQ ID NO: 424089 - DNA, 26 bp, Artificial Sequence
  Description of Artificial Sequence: Synthetic oligonucleotide
gaaggacttcctggaagacacgcgcg

SEQ ID NO: 424090 - DNA, 26 bp, Artificial Sequence
  Description of Artificial Sequence: Synthetic oligonucleotide
aaggacttcctggaagacacgcgcgc

SEQ ID NO: 424091 - DNA, 25 bp, Artificial Sequence
  Description of Artificial Sequence: Synthetic oligonucleotide
aggacttcctggaagacacgcgcgc

SEQ ID NO: 424092 - DNA, 24 bp, Artificial Sequence
  Description of Artificial Sequence: Synthetic oligonucleotide
ggacttcctggaagacacgcgcgc

SEQ ID NO: 424093 - DNA, 24 bp, Artificial Sequence
  Description of Artificial Sequence: Synthetic oligonucleotide
gacttcctggaagacacgcgcgcc

SEQ ID NO: 424094 - DNA, 24 bp, Artificial Sequence
  Description of Artificial Sequence: Synthetic oligonucleotide
acttcctggaagacacgcgcgccg

SEQ ID NO: 424095 - DNA, 23 bp, Artificial Sequence
  Description of Artificial Sequence: Synthetic oligonucleotide
cttcctggaagacacgcgcgccg

SEQ ID NO: 424096 - DNA, 23 bp, Artificial Sequence
  Description of Artificial Sequence: Synthetic oligonucleotide
ttcctggaagacacgcgcgccgc

SEQ ID NO: 424097 - DNA, 22 bp, Artificial Sequence
  Description of Artificial Sequence: Synthetic oligonucleotide
tcctggaagacacgcgcgccgc

SEQ ID NO: 424098 - DNA, 21 bp, Artificial Sequence
  Description of Artificial Sequence: Synthetic oligonucleotide
cctggaagacacgcgcgccgc

SEQ ID NO: 424099 - DNA, 21 bp, Artificial Sequence
  Description of Artificial Sequence: Synthetic oligonucleotide
ctggaagacacgcgcgccgcg

SEQ ID NO: 424100 - DNA, 22 bp, Artificial Sequence
  Description of Artificial Sequence: Synthetic oligonucleotide
tggaagacacgcgcgccgcggt

SEQ ID NO: 424101 - DNA, 21 bp, Artificial Sequence
  Description of Artificial Sequence: Synthetic oligonucleotide
ggaagacacgcgcgccgcggt

SEQ ID NO: 424102 - DNA, 21 bp, Artificial Sequence
  Description of Artificial Sequence: Synthetic oligonucleotide
gaagacacgcgcgccgcggtg

SEQ ID NO: 424103 - DNA, 22 bp, Artificial Sequence
  Description of Artificial Sequence: Synthetic oligonucleotide
aagacacgcgcgccgcggtgga

SEQ ID NO: 424104 - DNA, 21 bp, Artificial Sequence
  Description of Artificial Sequence: Synthetic oligonucleotide
agacacgcgcgccgcggtgga

SEQ ID NO: 424105 - DNA, 20 bp, Artificial Sequence
  Description of Artificial Sequence: Synthetic oligonucleotide
gacacgcgcgccgcggtgga

SEQ ID NO: 424106 - DNA, 21 bp, Artificial Sequence
  Description of Artificial Sequence: Synthetic oligonucleotide
acacgcgcgccgcggtggaca

SEQ ID NO: 424107 - DNA, 20 bp, Artificial Sequence
  Description of Artificial Sequence: Synthetic oligonucleotide
cacgcgcgccgcggtggaca

SEQ ID NO: 424108 - DNA, 20 bp, Artificial Sequence
  Description of Artificial Sequence: Synthetic oligonucleotide
acgcgcgccgcggtggacac

SEQ ID NO: 424109 - DNA, 20 bp, Artificial Sequence
  Description of Artificial Sequence: Synthetic oligonucleotide
cgcgcgccgcggtggacact

SEQ ID NO: 424110 - DNA, 24 bp, Artificial Sequence
  Description of Artificial Sequence: Synthetic oligonucleotide
caaggacccagaccctgcagcacc

SEQ ID NO: 424111 - DNA, 33 bp, Artificial Sequence; identical to SEQ ID NO: 75287
  Description of Artificial Sequence: Synthetic oligonucleotide

SEQ ID NO: 424112 - DNA, 32 bp, Artificial Sequence; identical to SEQ ID NO: 75288
  Description of Artificial Sequence: Synthetic oligonucleotide

SEQ ID NO: 424113 - DNA, 33 bp, Artificial Sequence; identical to SEQ ID NO: 75289
  Description of Artificial Sequence: Synthetic oligonucleotide

SEQ ID NO: 424114 - DNA, 33 bp, Artificial Sequence; identical to SEQ ID NO: 75290
  Description of Artificial Sequence: Synthetic oligonucleotide

SEQ ID NO: 424115 - DNA, 32 bp, Artificial Sequence; identical to SEQ ID NO: 75291
  Description of Artificial Sequence: Synthetic oligonucleotide

SEQ ID NO: 424116 - DNA, 32 bp, Artificial Sequence; identical to SEQ ID NO: 75292
  Description of Artificial Sequence: Synthetic oligonucleotide

SEQ ID NO: 424117 - DNA, 31 bp, Artificial Sequence; identical to SEQ ID NO: 75293
  Description of Artificial Sequence: Synthetic oligonucleotide

SEQ ID NO: 424118 - DNA, 31 bp, Artificial Sequence; identical to SEQ ID NO: 75294
  Description of Artificial Sequence: Synthetic oligonucleotide

SEQ ID NO: 424119 - DNA, 30 bp, Artificial Sequence; identical to SEQ ID NO: 75295
  Description of Artificial Sequence: Synthetic oligonucleotide

SEQ ID NO: 424120 - DNA, 32 bp, Artificial Sequence; identical to SEQ ID NO: 75296
  Description of Artificial Sequence: Synthetic oligonucleotide

SEQ ID NO: 424121 - DNA, 31 bp, Artificial Sequence; identical to SEQ ID NO: 75297
  Description of Artificial Sequence: Synthetic oligonucleotide

SEQ ID NO: 424122 - DNA, 31 bp, Artificial Sequence; identical to SEQ ID NO: 75298
  Description of Artificial Sequence: Synthetic oligonucleotide

SEQ ID NO: 424123 - DNA, 33 bp, Artificial Sequence; identical to SEQ ID NO: 75321
  Description of Artificial Sequence: Synthetic oligonucleotide

SEQ ID NO: 424124 - DNA, 32 bp, Artificial Sequence; identical to SEQ ID NO: 75322
  Description of Artificial Sequence: Synthetic oligonucleotide

SEQ ID NO: 424125 - DNA, 31 bp, Artificial Sequence; identical to SEQ ID NO: 75323
  Description of Artificial Sequence: Synthetic oligonucleotide

SEQ ID NO: 424126 - DNA, 32 bp, Artificial Sequence; identical to SEQ ID NO: 75324
  Description of Artificial Sequence: Synthetic oligonucleotide

SEQ ID NO: 424127 - DNA, 31 bp, Artificial Sequence; identical to SEQ ID NO: 75325
  Description of Artificial Sequence: Synthetic oligonucleotide

SEQ ID NO: 424128 - DNA, 31 bp, Artificial Sequence; identical to SEQ ID NO: 75326
  Description of Artificial Sequence: Synthetic oligonucleotide

SEQ ID NO: 424129 - DNA, 31 bp, Artificial Sequence; identical to SEQ ID NO: 75327
  Description of Artificial Sequence: Synthetic oligonucleotide

SEQ ID NO: 424130 - DNA, 30 bp, Artificial Sequence; identical to SEQ ID NO: 75328
  Description of Artificial Sequence: Synthetic oligonucleotide

SEQ ID NO: 424131 - DNA, 29 bp, Artificial Sequence
  Description of Artificial Sequence: Synthetic oligonucleotide
cagccagaaggacttcctggaaaacaggc

SEQ ID NO: 424132 - DNA, 29 bp, Artificial Sequence
  Description of Artificial Sequence: Synthetic oligonucleotide
agccagaaggacttcctggaaaacaggcg

SEQ ID NO: 424133 - DNA, 28 bp, Artificial Sequence
  Description of Artificial Sequence: Synthetic oligonucleotide
gccagaaggacttcctggaaaacaggcg

SEQ ID NO: 424134 - DNA, 28 bp, Artificial Sequence
  Description of Artificial Sequence: Synthetic oligonucleotide
ccagaaggacttcctggaaaacaggcgc

SEQ ID NO: 424135 - DNA, 28 bp, Artificial Sequence
  Description of Artificial Sequence: Synthetic oligonucleotide
cagaaggacttcctggaaaacaggcgcg

SEQ ID NO: 424136 - DNA, 28 bp, Artificial Sequence
  Description of Artificial Sequence: Synthetic oligonucleotide
agaaggacttcctggaaaacaggcgcgc

SEQ ID NO: 424137 - DNA, 27 bp, Artificial Sequence
  Description of Artificial Sequence: Synthetic oligonucleotide
gaaggacttcctggaaaacaggcgcgc

SEQ ID NO: 424138 - DNA, 27 bp, Artificial Sequence
  Description of Artificial Sequence: Synthetic oligonucleotide
aaggacttcctggaaaacaggcgcgcc

SEQ ID NO: 424139 - DNA, 26 bp, Artificial Sequence
  Description of Artificial Sequence: Synthetic oligonucleotide
aggacttcctggaaaacaggcgcgcc

SEQ ID NO: 424140 - DNA, 25 bp, Artificial Sequence
  Description of Artificial Sequence: Synthetic oligonucleotide
ggacttcctggaaaacaggcgcgcc

SEQ ID NO: 424141 - DNA, 25 bp, Artificial Sequence
  Description of Artificial Sequence: Synthetic oligonucleotide
gacttcctggaaaacaggcgcgccg

SEQ ID NO: 424142 - DNA, 25 bp, Artificial Sequence
  Description of Artificial Sequence: Synthetic oligonucleotide
acttcctggaaaacaggcgcgccgc

SEQ ID NO: 424143 - DNA, 24 bp, Artificial Sequence
  Description of Artificial Sequence: Synthetic oligonucleotide
cttcctggaaaacaggcgcgccgc

SEQ ID NO: 424144 - DNA, 24 bp, Artificial Sequence
  Description of Artificial Sequence: Synthetic oligonucleotide
ttcctggaaaacaggcgcgccgcg

SEQ ID NO: 424145 - DNA, 23 bp, Artificial Sequence
  Description of Artificial Sequence: Synthetic oligonucleotide
tcctggaaaacaggcgcgccgcg

SEQ ID NO: 424146 - DNA, 22 bp, Artificial Sequence
  Description of Artificial Sequence: Synthetic oligonucleotide
cctggaaaacaggcgcgccgcg

SEQ ID NO: 424147 - DNA, 23 bp, Artificial Sequence
  Description of Artificial Sequence: Synthetic oligonucleotide
ctggaaaacaggcgcgccgcggt

SEQ ID NO: 424148 - DNA, 23 bp, Artificial Sequence
  Description of Artificial Sequence: Synthetic oligonucleotide
tggaaaacaggcgcgccgcggtg

SEQ ID NO: 424149 - DNA, 22 bp, Artificial Sequence
  Description of Artificial Sequence: Synthetic oligonucleotide
ggaaaacaggcgcgccgcggtg

SEQ ID NO: 424150 - DNA, 23 bp, Artificial Sequence
  Description of Artificial Sequence: Synthetic oligonucleotide
gaaaacaggcgcgccgcggtgga

SEQ ID NO: 424151 - DNA, 24 bp, Artificial Sequence
  Description of Artificial Sequence: Synthetic oligonucleotide
aaaacaggcgcgccgcggtggaca

SEQ ID NO: 424152 - DNA, 23 bp, Artificial Sequence
  Description of Artificial Sequence: Synthetic oligonucleotide
aaacaggcgcgccgcggtggaca

SEQ ID NO: 424153 - DNA, 22 bp, Artificial Sequence
  Description of Artificial Sequence: Synthetic oligonucleotide
aacaggcgcgccgcggtggaca

SEQ ID NO: 424154 - DNA, 20 bp, Artificial Sequence
  Description of Artificial Sequence: Synthetic oligonucleotide
gagctggggcggcctgacgc

SEQ ID NO: 424155 - DNA, 20 bp, Artificial Sequence
  Description of Artificial Sequence: Synthetic oligonucleotide
agctggggcggcctgacgcc

SEQ ID NO: 424156 - DNA, 21 bp, Artificial Sequence
  Description of Artificial Sequence: Synthetic oligonucleotide
tggggcggcctgacgccgagt

SEQ ID NO: 424157 - DNA, 20 bp, Artificial Sequence
  Description of Artificial Sequence: Synthetic oligonucleotide
ggggcggcctgacgccgagt

SEQ ID NO: 424158 - DNA, 20 bp, Artificial Sequence
  Description of Artificial Sequence: Synthetic oligonucleotide
gggcggcctgacgccgagtc

SEQ ID NO: 424159 - DNA, 21 bp, Artificial Sequence
  Description of Artificial Sequence: Synthetic oligonucleotide
ggcggcctgacgccgagtcct

SEQ ID NO: 424160 - DNA, 21 bp, Artificial Sequence
  Description of Artificial Sequence: Synthetic oligonucleotide
gcggcctgacgccgagtcctg

SEQ ID NO: 424161 - DNA, 23 bp, Artificial Sequence
  Description of Artificial Sequence: Synthetic oligonucleotide
cggcctgacgccgagtcctggaa

SEQ ID NO: 424162 - DNA, 24 bp, Artificial Sequence
  Description of Artificial Sequence: Synthetic oligonucleotide
ggcctgacgccgagtcctggaaca

SEQ ID NO: 424163 - DNA, 24 bp, Artificial Sequence
  Description of Artificial Sequence: Synthetic oligonucleotide
gcctgacgccgagtcctggaacag

SEQ ID NO: 424164 - DNA, 24 bp, Artificial Sequence
  Description of Artificial Sequence: Synthetic oligonucleotide
cctgacgccgagtcctggaacagc

SEQ ID NO: 424165 - DNA, 25 bp, Artificial Sequence
  Description of Artificial Sequence: Synthetic oligonucleotide
ctgacgccgagtcctggaacagcca

SEQ ID NO: 424166 - DNA, 27 bp, Artificial Sequence
  Description of Artificial Sequence: Synthetic oligonucleotide
tgacgccgagtcctggaacagccagaa

SEQ ID NO: 424167 - DNA, 26 bp, Artificial Sequence
  Description of Artificial Sequence: Synthetic oligonucleotide
gacgccgagtcctggaacagccagaa

SEQ ID NO: 424168 - DNA, 26 bp, Artificial Sequence
  Description of Artificial Sequence: Synthetic oligonucleotide
acgccgagtcctggaacagccagaag

SEQ ID NO: 424169 - DNA, 36 bp, Artificial Sequence; identical to SEQ ID NO: 75388
  Description of Artificial Sequence: Synthetic oligonucleotide

SEQ ID NO: 424170 - DNA, 35 bp, Artificial Sequence; identical to SEQ ID NO: 75389
  Description of Artificial Sequence: Synthetic oligonucleotide

SEQ ID NO: 424171 - DNA, 34 bp, Artificial Sequence; identical to SEQ ID NO: 75390
  Description of Artificial Sequence: Synthetic oligonucleotide

SEQ ID NO: 424172 - DNA, 34 bp, Artificial Sequence; identical to SEQ ID NO: 75391
  Description of Artificial Sequence: Synthetic oligonucleotide

SEQ ID NO: 424173 - DNA, 35 bp, Artificial Sequence; identical to SEQ ID NO: 75392
  Description of Artificial Sequence: Synthetic oligonucleotide

SEQ ID NO: 424174 - DNA, 34 bp, Artificial Sequence; identical to SEQ ID NO: 75393
  Description of Artificial Sequence: Synthetic oligonucleotide

SEQ ID NO: 424175 - DNA, 34 bp, Artificial Sequence; identical to SEQ ID NO: 75394
  Description of Artificial Sequence: Synthetic oligonucleotide

SEQ ID NO: 424176 - DNA, 34 bp, Artificial Sequence; identical to SEQ ID NO: 75395
  Description of Artificial Sequence: Synthetic oligonucleotide

SEQ ID NO: 424177 - DNA, 33 bp, Artificial Sequence; identical to SEQ ID NO: 75396
  Description of Artificial Sequence: Synthetic oligonucleotide

SEQ ID NO: 424178 - DNA, 33 bp, Artificial Sequence; identical to SEQ ID NO: 75397
  Description of Artificial Sequence: Synthetic oligonucleotide

SEQ ID NO: 424179 - DNA, 32 bp, Artificial Sequence; identical to SEQ ID NO: 75398
  Description of Artificial Sequence: Synthetic oligonucleotide

SEQ ID NO: 424180 - DNA, 34 bp, Artificial Sequence; identical to SEQ ID NO: 75399
  Description of Artificial Sequence: Synthetic oligonucleotide

SEQ ID NO: 424181 - DNA, 33 bp, Artificial Sequence; identical to SEQ ID NO: 75400
  Description of Artificial Sequence: Synthetic oligonucleotide

SEQ ID NO: 424182 - DNA, 33 bp, Artificial Sequence; identical to SEQ ID NO: 75401
  Description of Artificial Sequence: Synthetic oligonucleotide

SEQ ID NO: 424183 - DNA, 28 bp, Artificial Sequence
  Description of Artificial Sequence: Synthetic oligonucleotide
aagctccctggaggttcctacatggcag

SEQ ID NO: 424184 - DNA, 27 bp, Artificial Sequence
  Description of Artificial Sequence: Synthetic oligonucleotide
agctccctggaggttcctacatggcag

SEQ ID NO: 424185 - DNA, 27 bp, Artificial Sequence
  Description of Artificial Sequence: Synthetic oligonucleotide
gctccctggaggttcctacatggcagt

SEQ ID NO: 424186 - DNA, 27 bp, Artificial Sequence
  Description of Artificial Sequence: Synthetic oligonucleotide
ctccctggaggttcctacatggcagtg

SEQ ID NO: 424187 - DNA, 27 bp, Artificial Sequence
  Description of Artificial Sequence: Synthetic oligonucleotide
tccctggaggttcctacatggcagtgc

SEQ ID NO: 424188 - DNA, 27 bp, Artificial Sequence
  Description of Artificial Sequence: Synthetic oligonucleotide
ccctggaggttcctacatggcagtgct

SEQ ID NO: 424189 - DNA, 27 bp, Artificial Sequence
  Description of Artificial Sequence: Synthetic oligonucleotide
cctggaggttcctacatggcagtgctg

SEQ ID NO: 424190 - DNA, 28 bp, Artificial Sequence
  Description of Artificial Sequence: Synthetic oligonucleotide
ctggaggttcctacatggcagtgctgac

SEQ ID NO: 424191 - DNA, 29 bp, Artificial Sequence
  Description of Artificial Sequence: Synthetic oligonucleotide
tggaggttcctacatggcagtgctgacag

SEQ ID NO: 424192 - DNA, 28 bp, Artificial Sequence
  Description of Artificial Sequence: Synthetic oligonucleotide
ggaggttcctacatggcagtgctgacag

SEQ ID NO: 424193 - DNA, 29 bp, Artificial Sequence
  Description of Artificial Sequence: Synthetic oligonucleotide
gaggttcctacatggcagtgctgacagtg

SEQ ID NO: 424194 - DNA, 30 bp, Artificial Sequence; identical to SEQ ID NO: 75413
  Description of Artificial Sequence: Synthetic oligonucleotide

SEQ ID NO: 424195 - DNA, 29 bp, Artificial Sequence
  Description of Artificial Sequence: Synthetic oligonucleotide
ggttcctacatggcagtgctgacagtgac

SEQ ID NO: 424196 - DNA, 30 bp, Artificial Sequence; identical to SEQ ID NO: 75415
  Description of Artificial Sequence: Synthetic oligonucleotide

SEQ ID NO: 424197 - DNA, 31 bp, Artificial Sequence; identical to SEQ ID NO: 75416
  Description of Artificial Sequence: Synthetic oligonucleotide

SEQ ID NO: 424198 - DNA, 30 bp, Artificial Sequence; identical to SEQ ID NO: 75417
  Description of Artificial Sequence: Synthetic oligonucleotide

SEQ ID NO: 424199 - DNA, 29 bp, Artificial Sequence
  Description of Artificial Sequence: Synthetic oligonucleotide
cctacatggcagtgctgacagtgacactg

SEQ ID NO: 424200 - DNA, 31 bp, Artificial Sequence; identical to SEQ ID NO: 75419
  Description of Artificial Sequence: Synthetic oligonucleotide

SEQ ID NO: 424201 - DNA, 31 bp, Artificial Sequence; identical to SEQ ID NO: 75420
  Description of Artificial Sequence: Synthetic oligonucleotide

SEQ ID NO: 424202 - DNA, 30 bp, Artificial Sequence; identical to SEQ ID NO: 75421
  Description of Artificial Sequence: Synthetic oligonucleotide

SEQ ID NO: 424203 - DNA, 29 bp, Artificial Sequence
  Description of Artificial Sequence: Synthetic oligonucleotide
catggcagtgctgacagtgacactgatgg

SEQ ID NO: 424204 - DNA, 30 bp, Artificial Sequence; identical to SEQ ID NO: 75423
  Description of Artificial Sequence: Synthetic oligonucleotide

SEQ ID NO: 424205 - DNA, 29 bp, Artificial Sequence
  Description of Artificial Sequence: Synthetic oligonucleotide
tggcagtgctgacagtgacactgatggtg

SEQ ID NO: 424206 - DNA, 28 bp, Artificial Sequence
  Description of Artificial Sequence: Synthetic oligonucleotide
ggcagtgctgacagtgacactgatggtg

SEQ ID NO: 424207 - DNA, 28 bp, Artificial Sequence
  Description of Artificial Sequence: Synthetic oligonucleotide
gcagtgctgacagtgacactgatggtgc

SEQ ID NO: 424208 - DNA, 29 bp, Artificial Sequence
  Description of Artificial Sequence: Synthetic oligonucleotide
cagtgctgacagtgacactgatggtgctg

SEQ ID NO: 424209 - DNA, 30 bp, Artificial Sequence; identical to SEQ ID NO: 75428
  Description of Artificial Sequence: Synthetic oligonucleotide

SEQ ID NO: 424210 - DNA, 29 bp, Artificial Sequence
  Description of Artificial Sequence: Synthetic oligonucleotide
gtgctgacagtgacactgatggtgctgag

SEQ ID NO: 424211 - DNA, 29 bp, Artificial Sequence
  Description of Artificial Sequence: Synthetic oligonucleotide
tgctgacagtgacactgatggtgctgagc

SEQ ID NO: 424212 - DNA, 25 bp, Artificial Sequence
  Description of Artificial Sequence: Synthetic oligonucleotide
gctttggctggggacacccgaccat

SEQ ID NO: 424213 - DNA, 27 bp, Artificial Sequence
  Description of Artificial Sequence: Synthetic oligonucleotide
ctttggctggggacacccgaccatgtt

SEQ ID NO: 424214 - DNA, 28 bp, Artificial Sequence
  Description of Artificial Sequence: Synthetic oligonucleotide
tttggctggggacacccgaccatgtttc

SEQ ID NO: 424215 - DNA, 27 bp, Artificial Sequence
  Description of Artificial Sequence: Synthetic oligonucleotide
ttggctggggacacccgaccatgtttc

SEQ ID NO: 424216 - DNA, 27 bp, Artificial Sequence
  Description of Artificial Sequence: Synthetic oligonucleotide
tggctggggacacccgaccatgtttct

SEQ ID NO: 424217 - DNA, 27 bp, Artificial Sequence
  Description of Artificial Sequence: Synthetic oligonucleotide
ggctggggacacccgaccatgtttctt

SEQ ID NO: 424218 - DNA, 27 bp, Artificial Sequence
  Description of Artificial Sequence: Synthetic oligonucleotide
gctggggacacccgaccatgtttcttg

SEQ ID NO: 424219 - DNA, 27 bp, Artificial Sequence
  Description of Artificial Sequence: Synthetic oligonucleotide
ctggggacacccgaccatgtttcttgc

SEQ ID NO: 424220 - DNA, 28 bp, Artificial Sequence
  Description of Artificial Sequence: Synthetic oligonucleotide
tggggacacccgaccatgtttcttgcag

SEQ ID NO: 424221 - DNA, 27 bp, Artificial Sequence
  Description of Artificial Sequence: Synthetic oligonucleotide
ggggacacccgaccatgtttcttgcag

SEQ ID NO: 424222 - DNA, 27 bp, Artificial Sequence
  Description of Artificial Sequence: Synthetic oligonucleotide
gggacacccgaccatgtttcttgcagc

SEQ ID NO: 424223 - DNA, 28 bp, Artificial Sequence
  Description of Artificial Sequence: Synthetic oligonucleotide
ggacacccgaccatgtttcttgcagcag

SEQ ID NO: 424224 - DNA, 28 bp, Artificial Sequence
  Description of Artificial Sequence: Synthetic oligonucleotide
gacacccgaccatgtttcttgcagcagg

SEQ ID NO: 424225 - DNA, 32 bp, Artificial Sequence; identical to SEQ ID NO: 75444
  Description of Artificial Sequence: Synthetic oligonucleotide

SEQ ID NO: 424226 - DNA, 31 bp, Artificial Sequence; identical to SEQ ID NO: 75445
  Description of Artificial Sequence: Synthetic oligonucleotide

SEQ ID NO: 424227 - DNA, 34 bp, Artificial Sequence; identical to SEQ ID NO: 75446
  Description of Artificial Sequence: Synthetic oligonucleotide

SEQ ID NO: 424228 - DNA, 33 bp, Artificial Sequence; identical to SEQ ID NO: 75447
  Description of Artificial Sequence: Synthetic oligonucleotide

SEQ ID NO: 424229 - DNA, 34 bp, Artificial Sequence; identical to SEQ ID NO: 75448
  Description of Artificial Sequence: Synthetic oligonucleotide

SEQ ID NO: 424230 - DNA, 35 bp, Artificial Sequence; identical to SEQ ID NO: 75449
  Description of Artificial Sequence: Synthetic oligonucleotide

SEQ ID NO: 424231 - DNA, 36 bp, Artificial Sequence; identical to SEQ ID NO: 75450
  Description of Artificial Sequence: Synthetic oligonucleotide

SEQ ID NO: 424232 - DNA, 40 bp, Artificial Sequence; identical to SEQ ID NO: 75451
  Description of Artificial Sequence: Synthetic oligonucleotide

SEQ ID NO: 424233 - DNA, 39 bp, Artificial Sequence; identical to SEQ ID NO: 75452
  Description of Artificial Sequence: Synthetic oligonucleotide

SEQ ID NO: 424234 - DNA, 41 bp, Artificial Sequence; identical to SEQ ID NO: 75453
  Description of Artificial Sequence: Synthetic oligonucleotide

SEQ ID NO: 424235 - DNA, 43 bp, Artificial Sequence; identical to SEQ ID NO: 75454
  Description of Artificial Sequence: Synthetic oligonucleotide

SEQ ID NO: 424236 - DNA, 42 bp, Artificial Sequence; identical to SEQ ID NO: 75455
  Description of Artificial Sequence: Synthetic oligonucleotide

SEQ ID NO: 424237 - DNA, 34 bp, Artificial Sequence; identical to SEQ ID NO: 75456
  Description of Artificial Sequence: Synthetic oligonucleotide

SEQ ID NO: 424238 - DNA, 35 bp, Artificial Sequence; identical to SEQ ID NO: 75457
  Description of Artificial Sequence: Synthetic oligonucleotide

SEQ ID NO: 424239 - DNA, 34 bp, Artificial Sequence; identical to SEQ ID NO: 75458
  Description of Artificial Sequence: Synthetic oligonucleotide

SEQ ID NO: 424240 - DNA, 34 bp, Artificial Sequence; identical to SEQ ID NO: 75459
  Description of Artificial Sequence: Synthetic oligonucleotide

SEQ ID NO: 424241 - DNA, 33 bp, Artificial Sequence; identical to SEQ ID NO: 75460
  Description of Artificial Sequence: Synthetic oligonucleotide

SEQ ID NO: 424242 - DNA, 32 bp, Artificial Sequence; identical to SEQ ID NO: 75461
  Description of Artificial Sequence: Synthetic oligonucleotide

SEQ ID NO: 424243 - DNA, 31 bp, Artificial Sequence; identical to SEQ ID NO: 75462
  Description of Artificial Sequence: Synthetic oligonucleotide

SEQ ID NO: 424244 - DNA, 32 bp, Artificial Sequence; identical to SEQ ID NO: 75463
  Description of Artificial Sequence: Synthetic oligonucleotide

SEQ ID NO: 424245 - DNA, 31 bp, Artificial Sequence; identical to SEQ ID NO: 75464
  Description of Artificial Sequence: Synthetic oligonucleotide

SEQ ID NO: 424246 - DNA, 33 bp, Artificial Sequence; identical to SEQ ID NO: 75465
  Description of Artificial Sequence: Synthetic oligonucleotide

SEQ ID NO: 424247 - DNA, 32 bp, Artificial Sequence; identical to SEQ ID NO: 75466
  Description of Artificial Sequence: Synthetic oligonucleotide

SEQ ID NO: 424248 - DNA, 31 bp, Artificial Sequence; identical to SEQ ID NO: 75467
  Description of Artificial Sequence: Synthetic oligonucleotide

SEQ ID NO: 424249 - DNA, 30 bp, Artificial Sequence; identical to SEQ ID NO: 75468
  Description of Artificial Sequence: Synthetic oligonucleotide

SEQ ID NO: 424250 - DNA, 30 bp, Artificial Sequence; identical to SEQ ID NO: 75469
  Description of Artificial Sequence: Synthetic oligonucleotide

SEQ ID NO: 424251 - DNA, 31 bp, Artificial Sequence; identical to SEQ ID NO: 75470
  Description of Artificial Sequence: Synthetic oligonucleotide

SEQ ID NO: 424252 - DNA, 30 bp, Artificial Sequence; identical to SEQ ID NO: 75471
  Description of Artificial Sequence: Synthetic oligonucleotide

SEQ ID NO: 424253 - DNA, 30 bp, Artificial Sequence; identical to SEQ ID NO: 75472
  Description of Artificial Sequence: Synthetic oligonucleotide

SEQ ID NO: 424254 - DNA, 29 bp, Artificial Sequence
  Description of Artificial Sequence: Synthetic oligonucleotide
ctggaccttccagattctggtgatgctgg

SEQ ID NO: 424255 - DNA, 32 bp, Artificial Sequence; identical to SEQ ID NO: 75474
  Description of Artificial Sequence: Synthetic oligonucleotide

SEQ ID NO: 424256 - DNA, 31 bp, Artificial Sequence; identical to SEQ ID NO: 75475
  Description of Artificial Sequence: Synthetic oligonucleotide

SEQ ID NO: 424257 - DNA, 32 bp, Artificial Sequence; identical to SEQ ID NO: 75476
  Description of Artificial Sequence: Synthetic oligonucleotide

SEQ ID NO: 424258 - DNA, 34 bp, Artificial Sequence; identical to SEQ ID NO: 75477
  Description of Artificial Sequence: Synthetic oligonucleotide

SEQ ID NO: 424259 - DNA, 33 bp, Artificial Sequence; identical to SEQ ID NO: 75478
  Description of Artificial Sequence: Synthetic oligonucleotide

SEQ ID NO: 424260 - DNA, 33 bp, Artificial Sequence; identical to SEQ ID NO: 75479
  Description of Artificial Sequence: Synthetic oligonucleotide

SEQ ID NO: 424261 - DNA, 34 bp, Artificial Sequence; identical to SEQ ID NO: 75480
  Description of Artificial Sequence: Synthetic oligonucleotide

SEQ ID NO: 424262 - DNA, 33 bp, Artificial Sequence; identical to SEQ ID NO: 75481
  Description of Artificial Sequence: Synthetic oligonucleotide

SEQ ID NO: 424263 - DNA, 32 bp, Artificial Sequence; identical to SEQ ID NO: 75482
  Description of Artificial Sequence: Synthetic oligonucleotide

SEQ ID NO: 424264 - DNA, 32 bp, Artificial Sequence; identical to SEQ ID NO: 75483
  Description of Artificial Sequence: Synthetic oligonucleotide

SEQ ID NO: 424265 - DNA, 32 bp, Artificial Sequence; identical to SEQ ID NO: 75484
  Description of Artificial Sequence: Synthetic oligonucleotide

SEQ ID NO: 424266 - DNA, 31 bp, Artificial Sequence; identical to SEQ ID NO: 75485
  Description of Artificial Sequence: Synthetic oligonucleotide

SEQ ID NO: 424267 - DNA, 32 bp, Artificial Sequence; identical to SEQ ID NO: 75486
  Description of Artificial Sequence: Synthetic oligonucleotide

SEQ ID NO: 424268 - DNA, 31 bp, Artificial Sequence; identical to SEQ ID NO: 75487
  Description of Artificial Sequence: Synthetic oligonucleotide

SEQ ID NO: 424269 - DNA, 30 bp, Artificial Sequence; identical to SEQ ID NO: 75488
  Description of Artificial Sequence: Synthetic oligonucleotide

SEQ ID NO: 424270 - DNA, 34 bp, Artificial Sequence; identical to SEQ ID NO: 75489
  Description of Artificial Sequence: Synthetic oligonucleotide

SEQ ID NO: 424271 - DNA, 33 bp, Artificial Sequence; identical to SEQ ID NO: 75490
  Description of Artificial Sequence: Synthetic oligonucleotide

SEQ ID NO: 424272 - DNA, 33 bp, Artificial Sequence; identical to SEQ ID NO: 75491
  Description of Artificial Sequence: Synthetic oligonucleotide

SEQ ID NO: 424273 - DNA, 32 bp, Artificial Sequence; identical to SEQ ID NO: 75492
  Description of Artificial Sequence: Synthetic oligonucleotide

SEQ ID NO: 424274 - DNA, 31 bp, Artificial Sequence; identical to SEQ ID NO: 75493
  Description of Artificial Sequence: Synthetic oligonucleotide

SEQ ID NO: 424275 - DNA, 30 bp, Artificial Sequence; identical to SEQ ID NO: 75494
  Description of Artificial Sequence: Synthetic oligonucleotide

SEQ ID NO: 424276 - DNA, 30 bp, Artificial Sequence; identical to SEQ ID NO: 75495
  Description of Artificial Sequence: Synthetic oligonucleotide

SEQ ID NO: 424277 - DNA, 29 bp, Artificial Sequence
  Description of Artificial Sequence: Synthetic oligonucleotide
gcacagagcaagatgctgagtggaatcgg

SEQ ID NO: 424278 - DNA, 29 bp, Artificial Sequence
  Description of Artificial Sequence: Synthetic oligonucleotide
cacagagcaagatgctgagtggaatcggg

SEQ ID NO: 424279 - DNA, 29 bp, Artificial Sequence
  Description of Artificial Sequence: Synthetic oligonucleotide
acagagcaagatgctgagtggaatcgggg

SEQ ID NO: 424280 - DNA, 28 bp, Artificial Sequence
  Description of Artificial Sequence: Synthetic oligonucleotide
cagagcaagatgctgagtggaatcgggg

SEQ ID NO: 424281 - DNA, 28 bp, Artificial Sequence
  Description of Artificial Sequence: Synthetic oligonucleotide
agagcaagatgctgagtggaatcggggg

SEQ ID NO: 424282 - DNA, 27 bp, Artificial Sequence
  Description of Artificial Sequence: Synthetic oligonucleotide
gagcaagatgctgagtggaatcggggg

SEQ ID NO: 424283 - DNA, 27 bp, Artificial Sequence
  Description of Artificial Sequence: Synthetic oligonucleotide
agcaagatgctgagtggaatcgggggc

SEQ ID NO: 424284 - DNA, 27 bp, Artificial Sequence
  Description of Artificial Sequence: Synthetic oligonucleotide
gcaagatgctgagtggaatcgggggct

SEQ ID NO: 424285 - DNA, 29 bp, Artificial Sequence
  Description of Artificial Sequence: Synthetic oligonucleotide
caagatgctgagtggaatcgggggctttg

SEQ ID NO: 424286 - DNA, 30 bp, Artificial Sequence; identical to SEQ ID NO: 75505
  Description of Artificial Sequence: Synthetic oligonucleotide

SEQ ID NO: 424287 - DNA, 29 bp, Artificial Sequence
  Description of Artificial Sequence: Synthetic oligonucleotide
agatgctgagtggaatcgggggctttgtg

SEQ ID NO: 424288 - DNA, 28 bp, Artificial Sequence
  Description of Artificial Sequence: Synthetic oligonucleotide
gatgctgagtggaatcgggggctttgtg

SEQ ID NO: 424289 - DNA, 28 bp, Artificial Sequence
  Description of Artificial Sequence: Synthetic oligonucleotide
atgctgagtggaatcgggggctttgtgc

SEQ ID NO: 424290 - DNA, 27 bp, Artificial Sequence
  Description of Artificial Sequence: Synthetic oligonucleotide
tgctgagtggaatcgggggctttgtgc

SEQ ID NO: 424291 - DNA, 27 bp, Artificial Sequence
  Description of Artificial Sequence: Synthetic oligonucleotide
gctgagtggaatcgggggctttgtgct

SEQ ID NO: 424292 - DNA, 27 bp, Artificial Sequence
  Description of Artificial Sequence: Synthetic oligonucleotide
ctgagtggaatcgggggctttgtgctg

SEQ ID NO: 424293 - DNA, 27 bp, Artificial Sequence
  Description of Artificial Sequence: Synthetic oligonucleotide
tgagtggaatcgggggctttgtgctgg

SEQ ID NO: 424294 - DNA, 26 bp, Artificial Sequence
  Description of Artificial Sequence: Synthetic oligonucleotide
gagtggaatcgggggctttgtgctgg

SEQ ID NO: 424295 - DNA, 26 bp, Artificial Sequence
  Description of Artificial Sequence: Synthetic oligonucleotide
agtggaatcgggggctttgtgctggg

SEQ ID NO: 424296 - DNA, 25 bp, Artificial Sequence
  Description of Artificial Sequence: Synthetic oligonucleotide
gtggaatcgggggctttgtgctggg

SEQ ID NO: 424297 - DNA, 25 bp, Artificial Sequence
  Description of Artificial Sequence: Synthetic oligonucleotide
tggaatcgggggctttgtgctgggc

SEQ ID NO: 424298 - DNA, 24 bp, Artificial Sequence
  Description of Artificial Sequence: Synthetic oligonucleotide
ggaatcgggggctttgtgctgggc

SEQ ID NO: 424299 - DNA, 25 bp, Artificial Sequence
  Description of Artificial Sequence: Synthetic oligonucleotide
gaatcgggggctttgtgctgggcct

SEQ ID NO: 424300 - DNA, 25 bp, Artificial Sequence
  Description of Artificial Sequence: Synthetic oligonucleotide
aatcgggggctttgtgctgggcctg

SEQ ID NO: 424301 - DNA, 24 bp, Artificial Sequence
  Description of Artificial Sequence: Synthetic oligonucleotide
atcgggggctttgtgctgggcctg

SEQ ID NO: 424302 - DNA, 30 bp, Artificial Sequence
  Description of Artificial Sequence: Synthetic oligonucleotide
caaagtgctgagattacaggcgtgagccac

SEQ ID NO: 424303 - DNA, 30 bp, Artificial Sequence
  Description of Artificial Sequence: Synthetic oligonucleotide
aaagtgctgagattacaggcgtgagccacc

SEQ ID NO: 424304 - DNA, 29 bp, Artificial Sequence
  Description of Artificial Sequence: Synthetic oligonucleotide
aagtgctgagattacaggcgtgagccacc

SEQ ID NO: 424305 - DNA, 28 bp, Artificial Sequence
  Description of Artificial Sequence: Synthetic oligonucleotide
agtgctgagattacaggcgtgagccacc

SEQ ID NO: 424306 - DNA, 27 bp, Artificial Sequence
  Description of Artificial Sequence: Synthetic oligonucleotide
gtgctgagattacaggcgtgagccacc

SEQ ID NO: 424307 - DNA, 27 bp, Artificial Sequence
  Description of Artificial Sequence: Synthetic oligonucleotide
tgctgagattacaggcgtgagccaccg

SEQ ID NO: 424308 - DNA, 26 bp, Artificial Sequence
  Description of Artificial Sequence: Synthetic oligonucleotide
gctgagattacaggcgtgagccaccg

SEQ ID NO: 424309 - DNA, 26 bp, Artificial Sequence
  Description of Artificial Sequence: Synthetic oligonucleotide
ctgagattacaggcgtgagccaccgc

SEQ ID NO: 424310 - DNA, 26 bp, Artificial Sequence
  Description of Artificial Sequence: Synthetic oligonucleotide
tgagattacaggcgtgagccaccgcg

SEQ ID NO: 424311 - DNA, 25 bp, Artificial Sequence
  Description of Artificial Sequence: Synthetic oligonucleotide
gagattacaggcgtgagccaccgcg

SEQ ID NO: 424312 - DNA, 25 bp, Artificial Sequence
  Description of Artificial Sequence: Synthetic oligonucleotide
agattacaggcgtgagccaccgcgc

SEQ ID NO: 424313 - DNA, 24 bp, Artificial Sequence
  Description of Artificial Sequence: Synthetic oligonucleotide
gattacaggcgtgagccaccgcgc

SEQ ID NO: 424314 - DNA, 24 bp, Artificial Sequence
  Description of Artificial Sequence: Synthetic oligonucleotide
attacaggcgtgagccaccgcgcc

SEQ ID NO: 424315 - DNA, 23 bp, Artificial Sequence
  Description of Artificial Sequence: Synthetic oligonucleotide
ttacaggcgtgagccaccgcgcc

SEQ ID NO: 424316 - DNA, 22 bp, Artificial Sequence
  Description of Artificial Sequence: Synthetic oligonucleotide
tacaggcgtgagccaccgcgcc

SEQ ID NO: 424317 - DNA, 21 bp, Artificial Sequence
  Description of Artificial Sequence: Synthetic oligonucleotide
acaggcgtgagccaccgcgcc

SEQ ID NO: 424318 - DNA, 20 bp, Artificial Sequence
  Description of Artificial Sequence: Synthetic oligonucleotide
caggcgtgagccaccgcgcc

SEQ ID NO: 424319 - DNA, 21 bp, Artificial Sequence
  Description of Artificial Sequence: Synthetic oligonucleotide
aggcgtgagccaccgcgccca

SEQ ID NO: 424320 - DNA, 20 bp, Artificial Sequence
  Description of Artificial Sequence: Synthetic oligonucleotide
ggcgtgagccaccgcgccca

SEQ ID NO: 424321 - DNA, 20 bp, Artificial Sequence
  Description of Artificial Sequence: Synthetic oligonucleotide
gcgtgagccaccgcgcccag

SEQ ID NO: 424322 - DNA, 20 bp, Artificial Sequence
  Description of Artificial Sequence: Synthetic oligonucleotide
cgtgagccaccgcgcccagc

SEQ ID NO: 424323 - DNA, 21 bp, Artificial Sequence
  Description of Artificial Sequence: Synthetic oligonucleotide
gtgagccaccgcgcccagcca

SEQ ID NO: 424324 - DNA, 21 bp, Artificial Sequence
  Description of Artificial Sequence: Synthetic oligonucleotide
tgagccaccgcgcccagccag

SEQ ID NO: 424325 - DNA, 20 bp, Artificial Sequence
  Description of Artificial Sequence: Synthetic oligonucleotide
gagccaccgcgcccagccag

SEQ ID NO: 424326 - DNA, 21 bp, Artificial Sequence
  Description of Artificial Sequence: Synthetic oligonucleotide
agccaccgcgcccagccagga

SEQ ID NO: 424327 - DNA, 20 bp, Artificial Sequence
  Description of Artificial Sequence: Synthetic oligonucleotide
gccaccgcgcccagccagga

SEQ ID NO: 424328 - DNA, 26 bp, Artificial Sequence
  Description of Artificial Sequence: Synthetic oligonucleotide
ccaccgcgcccagccaggactaattt

SEQ ID NO: 424329 - DNA, 27 bp, Artificial Sequence
  Description of Artificial Sequence: Synthetic oligonucleotide
caccgcgcccagccaggactaatttct

SEQ ID NO: 424330 - DNA, 29 bp, Artificial Sequence
  Description of Artificial Sequence: Synthetic oligonucleotide
accgcgcccagccaggactaatttctaag

SEQ ID NO: 424331 - DNA, 28 bp, Artificial Sequence
  Description of Artificial Sequence: Synthetic oligonucleotide
ccgcgcccagccaggactaatttctaag

SEQ ID NO: 424332 - DNA, 29 bp, Artificial Sequence
  Description of Artificial Sequence: Synthetic oligonucleotide
cgcgcccagccaggactaatttctaagag

SEQ ID NO: 424333 - DNA, 30 bp, Artificial Sequence
  Description of Artificial Sequence: Synthetic oligonucleotide
gcgcccagccaggactaatttctaagagtg

SEQ ID NO: 424334 - DNA, 31 bp, Artificial Sequence
  Description of Artificial Sequence: Synthetic oligonucleotide
cgcccagccaggactaatttctaagagtgtg

SEQ ID NO: 424335 - DNA, 31 bp, Artificial Sequence
  Description of Artificial Sequence: Synthetic oligonucleotide
gcccagccaggactaatttctaagagtgtgc

SEQ ID NO: 424336 - DNA, 32 bp, Artificial Sequence
  Description of Artificial Sequence: Synthetic oligonucleotide
cccagccaggactaatttctaagagtgtgcag

SEQ ID NO: 424337 - DNA, 33 bp, Artificial Sequence
  Description of Artificial Sequence: Synthetic oligonucleotide
ccagccaggactaatttctaagagtgtgcagag

SEQ ID NO: 424338 - DNA, 36 bp, Artificial Sequence
  Description of Artificial Sequence: Synthetic oligonucleotide
cagccaggactaatttctaagagtgtgcagagatac

SEQ ID NO: 424339 - DNA, 36 bp, Artificial Sequence
  Description of Artificial Sequence: Synthetic oligonucleotide
agccaggactaatttctaagagtgtgcagagatacc

SEQ ID NO: 424340 - DNA, 35 bp, Artificial Sequence
  Description of Artificial Sequence: Synthetic oligonucleotide
gccaggactaatttctaagagtgtgcagagatacc

SEQ ID NO: 424341 - DNA, 35 bp, Artificial Sequence
  Description of Artificial Sequence: Synthetic oligonucleotide
ccaggactaatttctaagagtgtgcagagataccg

SEQ ID NO: 424342 - DNA, 38 bp, Artificial Sequence
  Description of Artificial Sequence: Synthetic oligonucleotide
caggactaatttctaagagtgtgcagagataccgaaac

SEQ ID NO: 424343 - DNA, 38 bp, Artificial Sequence
  Description of Artificial Sequence: Synthetic oligonucleotide
aggactaatttctaagagtgtgcagagataccgaaacc

SEQ ID NO: 424344 - DNA, 37 bp, Artificial Sequence
  Description of Artificial Sequence: Synthetic oligonucleotide
ggactaatttctaagagtgtgcagagataccgaaacc

SEQ ID NO: 424345 - DNA, 42 bp, Artificial Sequence
  Description of Artificial Sequence: Synthetic oligonucleotide
gactaatttctaagagtgtgcagagataccgaaacctaaaag

SEQ ID NO: 424346 - DNA, 47 bp, Artificial Sequence
  Description of Artificial Sequence: Synthetic oligonucleotide
actaatttctaagagtgtgcagagataccgaaacctaaaagtttaag

SEQ ID NO: 424347 - DNA, 46 bp, Artificial Sequence
  Description of Artificial Sequence: Synthetic oligonucleotide
ctaatttctaagagtgtgcagagataccgaaacctaaaagtttaag

SEQ ID NO: 424348 - DNA, 48 bp, Artificial Sequence
  Description of Artificial Sequence: Synthetic oligonucleotide
taatttctaagagtgtgcagagataccgaaacctaaaagtttaagaac

SEQ ID NO: 424349 - DNA, 47 bp, Artificial Sequence
  Description of Artificial Sequence: Synthetic oligonucleotide
aatttctaagagtgtgcagagataccgaaacctaaaagtttaagaac

SEQ ID NO: 424350 - DNA, 46 bp, Artificial Sequence
  Description of Artificial Sequence: Synthetic oligonucleotide
atttctaagagtgtgcagagataccgaaacctaaaagtttaagaac

SEQ ID NO: 424351 - DNA, 45 bp, Artificial Sequence
  Description of Artificial Sequence: Synthetic oligonucleotide
tttctaagagtgtgcagagataccgaaacctaaaagtttaagaac

SEQ ID NO: 424352 - DNA, 44 bp, Artificial Sequence
  Description of Artificial Sequence: Synthetic oligonucleotide
ttctaagagtgtgcagagataccgaaacctaaaagtttaagaac

SEQ ID NO: 424353 - DNA, 43 bp, Artificial Sequence
  Description of Artificial Sequence: Synthetic oligonucleotide
tctaagagtgtgcagagataccgaaacctaaaagtttaagaac

SEQ ID NO: 424354 - DNA, 42 bp, Artificial Sequence
  Description of Artificial Sequence: Synthetic oligonucleotide
ctaagagtgtgcagagataccgaaacctaaaagtttaagaac

SEQ ID NO: 424355 - DNA, 43 bp, Artificial Sequence
  Description of Artificial Sequence: Synthetic oligonucleotide
taagagtgtgcagagataccgaaacctaaaagtttaagaactg

SEQ ID NO: 424356 - DNA, 42 bp, Artificial Sequence
  Description of Artificial Sequence: Synthetic oligonucleotide
aagagtgtgcagagataccgaaacctaaaagtttaagaactg

SEQ ID NO: 424357 - DNA, 41 bp, Artificial Sequence
  Description of Artificial Sequence: Synthetic oligonucleotide
agagtgtgcagagataccgaaacctaaaagtttaagaactg

SEQ ID NO: 424358 - DNA, 40 bp, Artificial Sequence
  Description of Artificial Sequence: Synthetic oligonucleotide
gagtgtgcagagataccgaaacctaaaagtttaagaactg

SEQ ID NO: 424359 - DNA, 40 bp, Artificial Sequence
  Description of Artificial Sequence: Synthetic oligonucleotide
agtgtgcagagataccgaaacctaaaagtttaagaactgc

SEQ ID NO: 424360 - DNA, 39 bp, Artificial Sequence
  Description of Artificial Sequence: Synthetic oligonucleotide
gtgtgcagagataccgaaacctaaaagtttaagaactgc

SEQ ID NO: 424361 - DNA, 40 bp, Artificial Sequence
  Description of Artificial Sequence: Synthetic oligonucleotide
tgtgcagagataccgaaacctaaaagtttaagaactgctg

SEQ ID NO: 424362 - DNA, 39 bp, Artificial Sequence
  Description of Artificial Sequence: Synthetic oligonucleotide
gtgcagagataccgaaacctaaaagtttaagaactgctg

SEQ ID NO: 424363 - DNA, 42 bp, Artificial Sequence
  Description of Artificial Sequence: Synthetic oligonucleotide
tgcagagataccgaaacctaaaagtttaagaactgctgattg

SEQ ID NO: 424364 - DNA, 41 bp, Artificial Sequence
  Description of Artificial Sequence: Synthetic oligonucleotide
gcagagataccgaaacctaaaagtttaagaactgctgattg

SEQ ID NO: 424365 - DNA, 41 bp, Artificial Sequence
  Description of Artificial Sequence: Synthetic oligonucleotide
cagagataccgaaacctaaaagtttaagaactgctgattgc

SEQ ID NO: 424366 - DNA, 42 bp, Artificial Sequence
  Description of Artificial Sequence: Synthetic oligonucleotide
agagataccgaaacctaaaagtttaagaactgctgattgctg

SEQ ID NO: 424367 - DNA, 41 bp, Artificial Sequence
  Description of Artificial Sequence: Synthetic oligonucleotide
gagataccgaaacctaaaagtttaagaactgctgattgctg

SEQ ID NO: 424368 - DNA, 41 bp, Artificial Sequence
  Description of Artificial Sequence: Synthetic oligonucleotide
agataccgaaacctaaaagtttaagaactgctgattgctgg

SEQ ID NO: 424369 - DNA, 40 bp, Artificial Sequence
  Description of Artificial Sequence: Synthetic oligonucleotide
gataccgaaacctaaaagtttaagaactgctgattgctgg

SEQ ID NO: 424370 - DNA, 40 bp, Artificial Sequence
  Description of Artificial Sequence: Synthetic oligonucleotide
ataccgaaacctaaaagtttaagaactgctgattgctggg

SEQ ID NO: 424371 - DNA, 39 bp, Artificial Sequence
  Description of Artificial Sequence: Synthetic oligonucleotide
taccgaaacctaaaagtttaagaactgctgattgctggg

SEQ ID NO: 424372 - DNA, 38 bp, Artificial Sequence
  Description of Artificial Sequence: Synthetic oligonucleotide
accgaaacctaaaagtttaagaactgctgattgctggg

SEQ ID NO: 424373 - DNA, 37 bp, Artificial Sequence
  Description of Artificial Sequence: Synthetic oligonucleotide
ccgaaacctaaaagtttaagaactgctgattgctggg

SEQ ID NO: 424374 - DNA, 40 bp, Artificial Sequence
  Description of Artificial Sequence: Synthetic oligonucleotide
cgaaacctaaaagtttaagaactgctgattgctgggaaac

SEQ ID NO: 424375 - DNA, 41 bp, Artificial Sequence
  Description of Artificial Sequence: Synthetic oligonucleotide
gaaacctaaaagtttaagaactgctgattgctgggaaactc

SEQ ID NO: 424376 - DNA, 42 bp, Artificial Sequence
  Description of Artificial Sequence: Synthetic oligonucleotide
aaacctaaaagtttaagaactgctgattgctgggaaactctg

SEQ ID NO: 424377 - DNA, 41 bp, Artificial Sequence
  Description of Artificial Sequence: Synthetic oligonucleotide
aacctaaaagtttaagaactgctgattgctgggaaactctg

SEQ ID NO: 424378 - DNA, 40 bp, Artificial Sequence
  Description of Artificial Sequence: Synthetic oligonucleotide
acctaaaagtttaagaactgctgattgctgggaaactctg

SEQ ID NO: 424379 - DNA, 39 bp, Artificial Sequence
  Description of Artificial Sequence: Synthetic oligonucleotide
cctaaaagtttaagaactgctgattgctgggaaactctg

SEQ ID NO: 424380 - DNA, 39 bp, Artificial Sequence
  Description of Artificial Sequence: Synthetic oligonucleotide
ctaaaagtttaagaactgctgattgctgggaaactctgc

SEQ ID NO: 424381 - DNA, 40 bp, Artificial Sequence
  Description of Artificial Sequence: Synthetic oligonucleotide
taaaagtttaagaactgctgattgctgggaaactctgcag

SEQ ID NO: 424382 - DNA, 39 bp, Artificial Sequence
  Description of Artificial Sequence: Synthetic oligonucleotide
aaaagtttaagaactgctgattgctgggaaactctgcag

SEQ ID NO: 424383 - DNA, 38 bp, Artificial Sequence
  Description of Artificial Sequence: Synthetic oligonucleotide
aaagtttaagaactgctgattgctgggaaactctgcag

SEQ ID NO: 424384 - DNA, 37 bp, Artificial Sequence
  Description of Artificial Sequence: Synthetic oligonucleotide
aagtttaagaactgctgattgctgggaaactctgcag

SEQ ID NO: 424385 - DNA, 36 bp, Artificial Sequence
  Description of Artificial Sequence: Synthetic oligonucleotide
agtttaagaactgctgattgctgggaaactctgcag

SEQ ID NO: 424386 - DNA, 35 bp, Artificial Sequence
  Description of Artificial Sequence: Synthetic oligonucleotide
gtttaagaactgctgattgctgggaaactctgcag

SEQ ID NO: 424387 - DNA, 38 bp, Artificial Sequence
  Description of Artificial Sequence: Synthetic oligonucleotide
tttaagaactgctgattgctgggaaactctgcagtttc

SEQ ID NO: 424388 - DNA, 37 bp, Artificial Sequence
  Description of Artificial Sequence: Synthetic oligonucleotide
ttaagaactgctgattgctgggaaactctgcagtttc

SEQ ID NO: 424389 - DNA, 36 bp, Artificial Sequence
  Description of Artificial Sequence: Synthetic oligonucleotide
taagaactgctgattgctgggaaactctgcagtttc

SEQ ID NO: 424390 - DNA, 35 bp, Artificial Sequence
  Description of Artificial Sequence: Synthetic oligonucleotide
aagaactgctgattgctgggaaactctgcagtttc

SEQ ID NO: 424391 - DNA, 34 bp, Artificial Sequence
  Description of Artificial Sequence: Synthetic oligonucleotide
agaactgctgattgctgggaaactctgcagtttc

SEQ ID NO: 424392 - DNA, 33 bp, Artificial Sequence
  Description of Artificial Sequence: Synthetic oligonucleotide
gaactgctgattgctgggaaactctgcagtttc

SEQ ID NO: 424393 - DNA, 33 bp, Artificial Sequence
  Description of Artificial Sequence: Synthetic oligonucleotide
aactgctgattgctgggaaactctgcagtttcc

SEQ ID NO: 424394 - DNA, 32 bp, Artificial Sequence
  Description of Artificial Sequence: Synthetic oligonucleotide
actgctgattgctgggaaactctgcagtttcc

SEQ ID NO: 424395 - DNA, 31 bp, Artificial Sequence
  Description of Artificial Sequence: Synthetic oligonucleotide
ctgctgattgctgggaaactctgcagtttcc

SEQ ID NO: 424396 - DNA, 31 bp, Artificial Sequence
  Description of Artificial Sequence: Synthetic oligonucleotide
tgctgattgctgggaaactctgcagtttccc

SEQ ID NO: 424397 - DNA, 30 bp, Artificial Sequence
  Description of Artificial Sequence: Synthetic oligonucleotide
gctgattgctgggaaactctgcagtttccc

SEQ ID NO: 424398 - DNA, 30 bp, Artificial Sequence
  Description of Artificial Sequence: Synthetic oligonucleotide
ctgattgctgggaaactctgcagtttcccg

SEQ ID NO: 424399 - DNA, 32 bp, Artificial Sequence
  Description of Artificial Sequence: Synthetic oligonucleotide
tgattgctgggaaactctgcagtttcccgttc

SEQ ID NO: 424400 - DNA, 31 bp, Artificial Sequence
  Description of Artificial Sequence: Synthetic oligonucleotide
gattgctgggaaactctgcagtttcccgttc

SEQ ID NO: 424401 - DNA, 31 bp, Artificial Sequence
  Description of Artificial Sequence: Synthetic oligonucleotide
attgctgggaaactctgcagtttcccgttcc

SEQ ID NO: 424402 - DNA, 30 bp, Artificial Sequence
  Description of Artificial Sequence: Synthetic oligonucleotide
ttgctgggaaactctgcagtttcccgttcc

SEQ ID NO: 424403 - DNA, 29 bp, Artificial Sequence
  Description of Artificial Sequence: Synthetic oligonucleotide
tgctgggaaactctgcagtttcccgttcc

SEQ ID NO: 424404 - DNA, 28 bp, Artificial Sequence
  Description of Artificial Sequence: Synthetic oligonucleotide
gctgggaaactctgcagtttcccgttcc

SEQ ID NO: 424405 - DNA, 29 bp, Artificial Sequence
  Description of Artificial Sequence: Synthetic oligonucleotide
ctgggaaactctgcagtttcccgttcctc

SEQ ID NO: 424406 - DNA, 30 bp, Artificial Sequence
  Description of Artificial Sequence: Synthetic oligonucleotide
tgggaaactctgcagtttcccgttcctctc

SEQ ID NO: 424407 - DNA, 29 bp, Artificial Sequence
  Description of Artificial Sequence: Synthetic oligonucleotide
gggaaactctgcagtttcccgttcctctc

SEQ ID NO: 424408 - DNA, 29 bp, Artificial Sequence
  Description of Artificial Sequence: Synthetic oligonucleotide
ggaaactctgcagtttcccgttcctctcg

SEQ ID NO: 424409 - DNA, 32 bp, Artificial Sequence
  Description of Artificial Sequence: Synthetic oligonucleotide
gaaactctgcagtttcccgttcctctcgtaac

SEQ ID NO: 424410 - DNA, 32 bp, Artificial Sequence
  Description of Artificial Sequence: Synthetic oligonucleotide
aaactctgcagtttcccgttcctctcgtaacc

SEQ ID NO: 424411 - DNA, 31 bp, Artificial Sequence
  Description of Artificial Sequence: Synthetic oligonucleotide
aactctgcagtttcccgttcctctcgtaacc

SEQ ID NO: 424412 - DNA, 30 bp, Artificial Sequence
  Description of Artificial Sequence: Synthetic oligonucleotide
actctgcagtttcccgttcctctcgtaacc

SEQ ID NO: 424413 - DNA, 29 bp, Artificial Sequence
  Description of Artificial Sequence: Synthetic oligonucleotide
ctctgcagtttcccgttcctctcgtaacc

SEQ ID NO: 424414 - DNA, 30 bp, Artificial Sequence
  Description of Artificial Sequence: Synthetic oligonucleotide
tctgcagtttcccgttcctctcgtaacctg

SEQ ID NO: 424415 - DNA, 29 bp, Artificial Sequence
  Description of Artificial Sequence: Synthetic oligonucleotide
ctgcagtttcccgttcctctcgtaacctg

SEQ ID NO: 424416 - DNA, 29 bp, Artificial Sequence
  Description of Artificial Sequence: Synthetic oligonucleotide
tgcagtttcccgttcctctcgtaacctgg

SEQ ID NO: 424417 - DNA, 28 bp, Artificial Sequence
  Description of Artificial Sequence: Synthetic oligonucleotide
gcagtttcccgttcctctcgtaacctgg

SEQ ID NO: 424418 - DNA, 29 bp, Artificial Sequence
  Description of Artificial Sequence: Synthetic oligonucleotide
cagtttcccgttcctctcgtaacctggtc

SEQ ID NO: 424419 - DNA, 31 bp, Artificial Sequence
  Description of Artificial Sequence: Synthetic oligonucleotide
agtttcccgttcctctcgtaacctggtcatg

SEQ ID NO: 424420 - DNA, 30 bp, Artificial Sequence
  Description of Artificial Sequence: Synthetic oligonucleotide
gtttcccgttcctctcgtaacctggtcatg

SEQ ID NO: 424421 - DNA, 31 bp, Artificial Sequence
  Description of Artificial Sequence: Synthetic oligonucleotide
tttcccgttcctctcgtaacctggtcatgtg

SEQ ID NO: 424422 - DNA, 30 bp, Artificial Sequence
  Description of Artificial Sequence: Synthetic oligonucleotide
ttcccgttcctctcgtaacctggtcatgtg

SEQ ID NO: 424423 - DNA, 29 bp, Artificial Sequence
  Description of Artificial Sequence: Synthetic oligonucleotide
tcccgttcctctcgtaacctggtcatgtg

SEQ ID NO: 424424 - DNA, 28 bp, Artificial Sequence
  Description of Artificial Sequence: Synthetic oligonucleotide
cccgttcctctcgtaacctggtcatgtg

SEQ ID NO: 424425 - DNA, 29 bp, Artificial Sequence
  Description of Artificial Sequence: Synthetic oligonucleotide
ccgttcctctcgtaacctggtcatgtgtc

SEQ ID NO: 424426 - DNA, 29 bp, Artificial Sequence
  Description of Artificial Sequence: Synthetic oligonucleotide
cgttcctctcgtaacctggtcatgtgtcc

SEQ ID NO: 424427 - DNA, 31 bp, Artificial Sequence
  Description of Artificial Sequence: Synthetic oligonucleotide
gttcctctcgtaacctggtcatgtgtccttc

SEQ ID NO: 424428 - DNA, 33 bp, Artificial Sequence
  Description of Artificial Sequence: Synthetic oligonucleotide
ttcctctcgtaacctggtcatgtgtccttcttc

SEQ ID NO: 424429 - DNA, 32 bp, Artificial Sequence
  Description of Artificial Sequence: Synthetic oligonucleotide
tcctctcgtaacctggtcatgtgtccttcttc

SEQ ID NO: 424430 - DNA, 31 bp, Artificial Sequence
  Description of Artificial Sequence: Synthetic oligonucleotide
cctctcgtaacctggtcatgtgtccttcttc

SEQ ID NO: 424431 - DNA, 31 bp, Artificial Sequence
  Description of Artificial Sequence: Synthetic oligonucleotide
ctctcgtaacctggtcatgtgtccttcttcc

SEQ ID NO: 424432 - DNA, 32 bp, Artificial Sequence
  Description of Artificial Sequence: Synthetic oligonucleotide
tctcgtaacctggtcatgtgtccttcttcctg

SEQ ID NO: 424433 - DNA, 31 bp, Artificial Sequence
  Description of Artificial Sequence: Synthetic oligonucleotide
ctcgtaacctggtcatgtgtccttcttcctg

SEQ ID NO: 424434 - DNA, 31 bp, Artificial Sequence
  Description of Artificial Sequence: Synthetic oligonucleotide
tcgtaacctggtcatgtgtccttcttcctgg

SEQ ID NO: 424435 - DNA, 30 bp, Artificial Sequence
  Description of Artificial Sequence: Synthetic oligonucleotide
cgtaacctggtcatgtgtccttcttcctgg

SEQ ID NO: 424436 - DNA, 33 bp, Artificial Sequence
  Description of Artificial Sequence: Synthetic oligonucleotide
gtaacctggtcatgtgtccttcttcctggatac

SEQ ID NO: 424437 - DNA, 34 bp, Artificial Sequence
  Description of Artificial Sequence: Synthetic oligonucleotide
taacctggtcatgtgtccttcttcctggatactc

SEQ ID NO: 424438 - DNA, 33 bp, Artificial Sequence
  Description of Artificial Sequence: Synthetic oligonucleotide
aacctggtcatgtgtccttcttcctggatactc

SEQ ID NO: 424439 - DNA, 32 bp, Artificial Sequence
  Description of Artificial Sequence: Synthetic oligonucleotide
acctggtcatgtgtccttcttcctggatactc

SEQ ID NO: 424440 - DNA, 31 bp, Artificial Sequence
  Description of Artificial Sequence: Synthetic oligonucleotide
cctggtcatgtgtccttcttcctggatactc

SEQ ID NO: 424441 - DNA, 33 bp, Artificial Sequence
  Description of Artificial Sequence: Synthetic oligonucleotide
ctggtcatgtgtccttcttcctggatactcatg

SEQ ID NO: 424442 - DNA, 34 bp, Artificial Sequence
  Description of Artificial Sequence: Synthetic oligonucleotide
tggtcatgtgtccttcttcctggatactcatgac

SEQ ID NO: 424443 - DNA, 33 bp, Artificial Sequence
  Description of Artificial Sequence: Synthetic oligonucleotide
ggtcatgtgtccttcttcctggatactcatgac

SEQ ID NO: 424444 - DNA, 33 bp, Artificial Sequence
  Description of Artificial Sequence: Synthetic oligonucleotide
gtcatgtgtccttcttcctggatactcatgacg

SEQ ID NO: 424445 - DNA, 33 bp, Artificial Sequence
  Description of Artificial Sequence: Synthetic oligonucleotide
tcatgtgtccttcttcctggatactcatgacgc

SEQ ID NO: 424446 - DNA, 32 bp, Artificial Sequence
  Description of Artificial Sequence: Synthetic oligonucleotide
catgtgtccttcttcctggatactcatgacgc

SEQ ID NO: 424447 - DNA, 33 bp, Artificial Sequence
  Description of Artificial Sequence: Synthetic oligonucleotide
atgtgtccttcttcctggatactcatgacgcag

SEQ ID NO: 424448 - DNA, 32 bp, Artificial Sequence
  Description of Artificial Sequence: Synthetic oligonucleotide
tgtgtccttcttcctggatactcatgacgcag

SEQ ID NO: 424449 - DNA, 31 bp, Artificial Sequence
  Description of Artificial Sequence: Synthetic oligonucleotide
gtgtccttcttcctggatactcatgacgcag

SEQ ID NO: 424450 - DNA, 32 bp, Artificial Sequence
  Description of Artificial Sequence: Synthetic oligonucleotide
tgtccttcttcctggatactcatgacgcagac

SEQ ID NO: 424451 - DNA, 31 bp, Artificial Sequence
  Description of Artificial Sequence: Synthetic oligonucleotide
gtccttcttcctggatactcatgacgcagac

SEQ ID NO: 424452 - DNA, 32 bp, Artificial Sequence
  Description of Artificial Sequence: Synthetic oligonucleotide
tccttcttcctggatactcatgacgcagactc

SEQ ID NO: 424453 - DNA, 31 bp, Artificial Sequence
  Description of Artificial Sequence: Synthetic oligonucleotide
ccttcttcctggatactcatgacgcagactc

SEQ ID NO: 424454 - DNA, 32 bp, Artificial Sequence
  Description of Artificial Sequence: Synthetic oligonucleotide
cttcttcctggatactcatgacgcagactcag

SEQ ID NO: 424455 - DNA, 34 bp, Artificial Sequence
  Description of Artificial Sequence: Synthetic oligonucleotide
ttcttcctggatactcatgacgcagactcagttc

SEQ ID NO: 424456 - DNA, 33 bp, Artificial Sequence
  Description of Artificial Sequence: Synthetic oligonucleotide
tcttcctggatactcatgacgcagactcagttc

SEQ ID NO: 424457 - DNA, 32 bp, Artificial Sequence
  Description of Artificial Sequence: Synthetic oligonucleotide
cttcctggatactcatgacgcagactcagttc

SEQ ID NO: 424458 - DNA, 33 bp, Artificial Sequence
  Description of Artificial Sequence: Synthetic oligonucleotide
ttcctggatactcatgacgcagactcagttctc

SEQ ID NO: 424459 - DNA, 32 bp, Artificial Sequence
  Description of Artificial Sequence: Synthetic oligonucleotide
tcctggatactcatgacgcagactcagttctc

SEQ ID NO: 424460 - DNA, 31 bp, Artificial Sequence
  Description of Artificial Sequence: Synthetic oligonucleotide
cctggatactcatgacgcagactcagttctc

SEQ ID NO: 424461 - DNA, 34 bp, Artificial Sequence
  Description of Artificial Sequence: Synthetic oligonucleotide
ctggatactcatgacgcagactcagttctcattc

SEQ ID NO: 424462 - DNA, 34 bp, Artificial Sequence
  Description of Artificial Sequence: Synthetic oligonucleotide
tggatactcatgacgcagactcagttctcattcc

SEQ ID NO: 424463 - DNA, 33 bp, Artificial Sequence
  Description of Artificial Sequence: Synthetic oligonucleotide
ggatactcatgacgcagactcagttctcattcc

SEQ ID NO: 424464 - DNA, 33 bp, Artificial Sequence
  Description of Artificial Sequence: Synthetic oligonucleotide
gatactcatgacgcagactcagttctcattccc

SEQ ID NO: 424465 - DNA, 36 bp, Artificial Sequence
  Description of Artificial Sequence: Synthetic oligonucleotide
atactcatgacgcagactcagttctcattcccaatg

SEQ ID NO: 424466 - DNA, 35 bp, Artificial Sequence
  Description of Artificial Sequence: Synthetic oligonucleotide
tactcatgacgcagactcagttctcattcccaatg

SEQ ID NO: 424467 - DNA, 34 bp, Artificial Sequence
  Description of Artificial Sequence: Synthetic oligonucleotide
actcatgacgcagactcagttctcattcccaatg

SEQ ID NO: 424468 - DNA, 33 bp, Artificial Sequence
  Description of Artificial Sequence: Synthetic oligonucleotide
ctcatgacgcagactcagttctcattcccaatg

SEQ ID NO: 424469 - DNA, 33 bp, Artificial Sequence
  Description of Artificial Sequence: Synthetic oligonucleotide
tcatgacgcagactcagttctcattcccaatgg

SEQ ID NO: 424470 - DNA, 32 bp, Artificial Sequence
  Description of Artificial Sequence: Synthetic oligonucleotide
catgacgcagactcagttctcattcccaatgg

SEQ ID NO: 424471 - DNA, 32 bp, Artificial Sequence
  Description of Artificial Sequence: Synthetic oligonucleotide
atgacgcagactcagttctcattcccaatggg

SEQ ID NO: 424472 - DNA, 31 bp, Artificial Sequence
  Description of Artificial Sequence: Synthetic oligonucleotide
tgacgcagactcagttctcattcccaatggg

SEQ ID NO: 424473 - DNA, 30 bp, Artificial Sequence
  Description of Artificial Sequence: Synthetic oligonucleotide
gacgcagactcagttctcattcccaatggg

SEQ ID NO: 424474 - DNA, 31 bp, Artificial Sequence
  Description of Artificial Sequence: Synthetic oligonucleotide
acgcagactcagttctcattcccaatgggtg

SEQ ID NO: 424475 - DNA, 30 bp, Artificial Sequence
  Description of Artificial Sequence: Synthetic oligonucleotide
cgcagactcagttctcattcccaatgggtg

SEQ ID NO: 424476 - DNA, 31 bp, Artificial Sequence
  Description of Artificial Sequence: Synthetic oligonucleotide
gcagactcagttctcattcccaatgggtgtc

SEQ ID NO: 424477 - DNA, 31 bp, Artificial Sequence
  Description of Artificial Sequence: Synthetic oligonucleotide
cagactcagttctcattcccaatgggtgtcg

SEQ ID NO: 424478 - DNA, 31 bp, Artificial Sequence
  Description of Artificial Sequence: Synthetic oligonucleotide
agactcagttctcattcccaatgggtgtcgg

SEQ ID NO: 424479 - DNA, 30 bp, Artificial Sequence
  Description of Artificial Sequence: Synthetic oligonucleotide
gactcagttctcattcccaatgggtgtcgg

SEQ ID NO: 424480 - DNA, 30 bp, Artificial Sequence
  Description of Artificial Sequence: Synthetic oligonucleotide
actcagttctcattcccaatgggtgtcggg

SEQ ID NO: 424481 - DNA, 29 bp, Artificial Sequence
  Description of Artificial Sequence: Synthetic oligonucleotide
ctcagttctcattcccaatgggtgtcggg

SEQ ID NO: 424482 - DNA, 32 bp, Artificial Sequence
  Description of Artificial Sequence: Synthetic oligonucleotide
tcagttctcattcccaatgggtgtcgggtttc

SEQ ID NO: 424483 - DNA, 31 bp, Artificial Sequence
  Description of Artificial Sequence: Synthetic oligonucleotide
cagttctcattcccaatgggtgtcgggtttc

SEQ ID NO: 424484 - DNA, 33 bp, Artificial Sequence
  Description of Artificial Sequence: Synthetic oligonucleotide
agttctcattcccaatgggtgtcgggtttctag

SEQ ID NO: 424485 - DNA, 32 bp, Artificial Sequence
  Description of Artificial Sequence: Synthetic oligonucleotide
gttctcattcccaatgggtgtcgggtttctag

SEQ ID NO: 424486 - DNA, 33 bp, Artificial Sequence
  Description of Artificial Sequence: Synthetic oligonucleotide
ttctcattcccaatgggtgtcgggtttctagag

SEQ ID NO: 424487 - DNA, 32 bp, Artificial Sequence
  Description of Artificial Sequence: Synthetic oligonucleotide
tctcattcccaatgggtgtcgggtttctagag

SEQ ID NO: 424488 - DNA, 31 bp, Artificial Sequence
  Description of Artificial Sequence: Synthetic oligonucleotide
ctcattcccaatgggtgtcgggtttctagag

SEQ ID NO: 424489 - DNA, 33 bp, Artificial Sequence
  Description of Artificial Sequence: Synthetic oligonucleotide
tcattcccaatgggtgtcgggtttctagagaag

SEQ ID NO: 424490 - DNA, 32 bp, Artificial Sequence
  Description of Artificial Sequence: Synthetic oligonucleotide
cattcccaatgggtgtcgggtttctagagaag

SEQ ID NO: 424491 - DNA, 32 bp, Artificial Sequence
  Description of Artificial Sequence: Synthetic oligonucleotide
attcccaatgggtgtcgggtttctagagaagc

SEQ ID NO: 424492 - DNA, 31 bp, Artificial Sequence
  Description of Artificial Sequence: Synthetic oligonucleotide
ttcccaatgggtgtcgggtttctagagaagc

SEQ ID NO: 424493 - DNA, 30 bp, Artificial Sequence
  Description of Artificial Sequence: Synthetic oligonucleotide
tcccaatgggtgtcgggtttctagagaagc

SEQ ID NO: 424494 - DNA, 29 bp, Artificial Sequence
  Description of Artificial Sequence: Synthetic oligonucleotide
cccaatgggtgtcgggtttctagagaagc

SEQ ID NO: 424495 - DNA, 29 bp, Artificial Sequence
  Description of Artificial Sequence: Synthetic oligonucleotide
ccaatgggtgtcgggtttctagagaagcc

SEQ ID NO: 424496 - DNA, 32 bp, Artificial Sequence
  Description of Artificial Sequence: Synthetic oligonucleotide
caatgggtgtcgggtttctagagaagccaatc

SEQ ID NO: 424497 - DNA, 33 bp, Artificial Sequence
  Description of Artificial Sequence: Synthetic oligonucleotide
aatgggtgtcgggtttctagagaagccaatcag

SEQ ID NO: 424498 - DNA, 32 bp, Artificial Sequence
  Description of Artificial Sequence: Synthetic oligonucleotide
atgggtgtcgggtttctagagaagccaatcag

SEQ ID NO: 424499 - DNA, 31 bp, Artificial Sequence
  Description of Artificial Sequence: Synthetic oligonucleotide
tgggtgtcgggtttctagagaagccaatcag

SEQ ID NO: 424500 - DNA, 30 bp, Artificial Sequence
  Description of Artificial Sequence: Synthetic oligonucleotide
gggtgtcgggtttctagagaagccaatcag

SEQ ID NO: 424501 - DNA, 30 bp, Artificial Sequence
  Description of Artificial Sequence: Synthetic oligonucleotide
ggtgtcgggtttctagagaagccaatcagc

SEQ ID NO: 424502 - DNA, 30 bp, Artificial Sequence
  Description of Artificial Sequence: Synthetic oligonucleotide
gtgtcgggtttctagagaagccaatcagcg

SEQ ID NO: 424503 - DNA, 31 bp, Artificial Sequence
  Description of Artificial Sequence: Synthetic oligonucleotide
tgtcgggtttctagagaagccaatcagcgtc

SEQ ID NO: 424504 - DNA, 30 bp, Artificial Sequence
  Description of Artificial Sequence: Synthetic oligonucleotide
gtcgggtttctagagaagccaatcagcgtc

SEQ ID NO: 424505 - DNA, 30 bp, Artificial Sequence
  Description of Artificial Sequence: Synthetic oligonucleotide
tcgggtttctagagaagccaatcagcgtcg

SEQ ID NO: 424506 - DNA, 29 bp, Artificial Sequence
  Description of Artificial Sequence: Synthetic oligonucleotide
cgggtttctagagaagccaatcagcgtcg

SEQ ID NO: 424507 - DNA, 29 bp, Artificial Sequence
  Description of Artificial Sequence: Synthetic oligonucleotide
gggtttctagagaagccaatcagcgtcgc

SEQ ID NO: 424508 - DNA, 29 bp, Artificial Sequence
  Description of Artificial Sequence: Synthetic oligonucleotide
ggtttctagagaagccaatcagcgtcgcc

SEQ ID NO: 424509 - DNA, 30 bp, Artificial Sequence
  Description of Artificial Sequence: Synthetic oligonucleotide
gtttctagagaagccaatcagcgtcgccac

SEQ ID NO: 424510 - DNA, 30 bp, Artificial Sequence
  Description of Artificial Sequence: Synthetic oligonucleotide
tttctagagaagccaatcagcgtcgccacg

SEQ ID NO: 424511 - DNA, 29 bp, Artificial Sequence
  Description of Artificial Sequence: Synthetic oligonucleotide
ttctagagaagccaatcagcgtcgccacg

SEQ ID NO: 424512 - DNA, 28 bp, Artificial Sequence
  Description of Artificial Sequence: Synthetic oligonucleotide
tctagagaagccaatcagcgtcgccacg

SEQ ID NO: 424513 - DNA, 27 bp, Artificial Sequence
  Description of Artificial Sequence: Synthetic oligonucleotide
ctagagaagccaatcagcgtcgccacg

SEQ ID NO: 424514 - DNA, 28 bp, Artificial Sequence
  Description of Artificial Sequence: Synthetic oligonucleotide
tagagaagccaatcagcgtcgccacgac

SEQ ID NO: 424515 - DNA, 27 bp, Artificial Sequence
  Description of Artificial Sequence: Synthetic oligonucleotide
agagaagccaatcagcgtcgccacgac

SEQ ID NO: 424516 - DNA, 27 bp, Artificial Sequence
  Description of Artificial Sequence: Synthetic oligonucleotide
gagaagccaatcagcgtcgccacgact

SEQ ID NO: 424517 - DNA, 27 bp, Artificial Sequence
  Description of Artificial Sequence: Synthetic oligonucleotide
agaagccaatcagcgtcgccacgactc

SEQ ID NO: 424518 - DNA, 26 bp, Artificial Sequence
  Description of Artificial Sequence: Synthetic oligonucleotide
gaagccaatcagcgtcgccacgactc

SEQ ID NO: 424519 - DNA, 26 bp, Artificial Sequence
  Description of Artificial Sequence: Synthetic oligonucleotide
aagccaatcagcgtcgccacgactcc

SEQ ID NO: 424520 - DNA, 25 bp, Artificial Sequence
  Description of Artificial Sequence: Synthetic oligonucleotide
agccaatcagcgtcgccacgactcc

SEQ ID NO: 424521 - DNA, 24 bp, Artificial Sequence
  Description of Artificial Sequence: Synthetic oligonucleotide
gccaatcagcgtcgccacgactcc

SEQ ID NO: 424522 - DNA, 24 bp, Artificial Sequence
  Description of Artificial Sequence: Synthetic oligonucleotide
ccaatcagcgtcgccacgactccc

SEQ ID NO: 424523 - DNA, 25 bp, Artificial Sequence
  Description of Artificial Sequence: Synthetic oligonucleotide
caatcagcgtcgccacgactcccga

SEQ ID NO: 424524 - DNA, 27 bp, Artificial Sequence
  Description of Artificial Sequence: Synthetic oligonucleotide
aatcagcgtcgccacgactcccgacta

SEQ ID NO: 424525 - DNA, 27 bp, Artificial Sequence
  Description of Artificial Sequence: Synthetic oligonucleotide
atcagcgtcgccacgactcccgactat

SEQ ID NO: 424526 - DNA, 27 bp, Artificial Sequence
  Description of Artificial Sequence: Synthetic oligonucleotide
tcagcgtcgccacgactcccgactata

SEQ ID NO: 424527 - DNA, 27 bp, Artificial Sequence
  Description of Artificial Sequence: Synthetic oligonucleotide
cagcgtcgccacgactcccgactataa

SEQ ID NO: 424528 - DNA, 28 bp, Artificial Sequence
  Description of Artificial Sequence: Synthetic oligonucleotide
agcgtcgccacgactcccgactataaag

SEQ ID NO: 424529 - DNA, 27 bp, Artificial Sequence
  Description of Artificial Sequence: Synthetic oligonucleotide
gcgtcgccacgactcccgactataaag

SEQ ID NO: 424530 - DNA, 28 bp, Artificial Sequence
  Description of Artificial Sequence: Synthetic oligonucleotide
cgtcgccacgactcccgactataaagtc

SEQ ID NO: 424531 - DNA, 28 bp, Artificial Sequence
  Description of Artificial Sequence: Synthetic oligonucleotide
gtcgccacgactcccgactataaagtcc

SEQ ID NO: 424532 - DNA, 28 bp, Artificial Sequence
  Description of Artificial Sequence: Synthetic oligonucleotide
tcgccacgactcccgactataaagtccc

SEQ ID NO: 424533 - DNA, 27 bp, Artificial Sequence
  Description of Artificial Sequence: Synthetic oligonucleotide
cgccacgactcccgactataaagtccc

SEQ ID NO: 424534 - DNA, 27 bp, Artificial Sequence
  Description of Artificial Sequence: Synthetic oligonucleotide
gccacgactcccgactataaagtcccc

SEQ ID NO: 424535 - DNA, 29 bp, Artificial Sequence
  Description of Artificial Sequence: Synthetic oligonucleotide
ccacgactcccgactataaagtccccatc

SEQ ID NO: 424536 - DNA, 29 bp, Artificial Sequence
  Description of Artificial Sequence: Synthetic oligonucleotide
cacgactcccgactataaagtccccatcc

SEQ ID NO: 424537 - DNA, 29 bp, Artificial Sequence
  Description of Artificial Sequence: Synthetic oligonucleotide
acgactcccgactataaagtccccatccg

SEQ ID NO: 424538 - DNA, 28 bp, Artificial Sequence
  Description of Artificial Sequence: Synthetic oligonucleotide
cgactcccgactataaagtccccatccg

SEQ ID NO: 424539 - DNA, 28 bp, Artificial Sequence
  Description of Artificial Sequence: Synthetic oligonucleotide
gactcccgactataaagtccccatccgg

SEQ ID NO: 424540 - DNA, 29 bp, Artificial Sequence
  Description of Artificial Sequence: Synthetic oligonucleotide
actcccgactataaagtccccatccggac

SEQ ID NO: 424541 - DNA, 28 bp, Artificial Sequence
  Description of Artificial Sequence: Synthetic oligonucleotide
ctcccgactataaagtccccatccggac

SEQ ID NO: 424542 - DNA, 29 bp, Artificial Sequence
  Description of Artificial Sequence: Synthetic oligonucleotide
tcccgactataaagtccccatccggactc

SEQ ID NO: 424543 - DNA, 28 bp, Artificial Sequence
  Description of Artificial Sequence: Synthetic oligonucleotide
cccgactataaagtccccatccggactc

SEQ ID NO: 424544 - DNA, 30 bp, Artificial Sequence
  Description of Artificial Sequence: Synthetic oligonucleotide
ccgactataaagtccccatccggactcaag

SEQ ID NO: 424545 - DNA, 32 bp, Artificial Sequence
  Description of Artificial Sequence: Synthetic oligonucleotide
cgactataaagtccccatccggactcaagaag

SEQ ID NO: 424546 - DNA, 34 bp, Artificial Sequence
  Description of Artificial Sequence: Synthetic oligonucleotide
gactataaagtccccatccggactcaagaagttc

SEQ ID NO: 424547 - DNA, 35 bp, Artificial Sequence
  Description of Artificial Sequence: Synthetic oligonucleotide
actataaagtccccatccggactcaagaagttctc

SEQ ID NO: 424548 - DNA, 34 bp, Artificial Sequence
  Description of Artificial Sequence: Synthetic oligonucleotide
ctataaagtccccatccggactcaagaagttctc

SEQ ID NO: 424549 - DNA, 35 bp, Artificial Sequence
  Description of Artificial Sequence: Synthetic oligonucleotide
tataaagtccccatccggactcaagaagttctcag

SEQ ID NO: 424550 - DNA, 34 bp, Artificial Sequence
  Description of Artificial Sequence: Synthetic oligonucleotide
ataaagtccccatccggactcaagaagttctcag

SEQ ID NO: 424551 - DNA, 33 bp, Artificial Sequence
  Description of Artificial Sequence: Synthetic oligonucleotide
taaagtccccatccggactcaagaagttctcag

SEQ ID NO: 424552 - DNA, 32 bp, Artificial Sequence
  Description of Artificial Sequence: Synthetic oligonucleotide
aaagtccccatccggactcaagaagttctcag

SEQ ID NO: 424553 - DNA, 31 bp, Artificial Sequence
  Description of Artificial Sequence: Synthetic oligonucleotide
aagtccccatccggactcaagaagttctcag

SEQ ID NO: 424554 - DNA, 30 bp, Artificial Sequence
  Description of Artificial Sequence: Synthetic oligonucleotide
agtccccatccggactcaagaagttctcag

SEQ ID NO: 424555 - DNA, 29 bp, Artificial Sequence
  Description of Artificial Sequence: Synthetic oligonucleotide
gtccccatccggactcaagaagttctcag

SEQ ID NO: 424556 - DNA, 29 bp, Artificial Sequence
  Description of Artificial Sequence: Synthetic oligonucleotide
tccccatccggactcaagaagttctcagg

SEQ ID NO: 424557 - DNA, 28 bp, Artificial Sequence
  Description of Artificial Sequence: Synthetic oligonucleotide
ccccatccggactcaagaagttctcagg

SEQ ID NO: 424558 - DNA, 29 bp, Artificial Sequence
  Description of Artificial Sequence: Synthetic oligonucleotide
cccatccggactcaagaagttctcaggac

SEQ ID NO: 424559 - DNA, 30 bp, Artificial Sequence
  Description of Artificial Sequence: Synthetic oligonucleotide
ccatccggactcaagaagttctcaggactc

SEQ ID NO: 424560 - DNA, 31 bp, Artificial Sequence
  Description of Artificial Sequence: Synthetic oligonucleotide
catccggactcaagaagttctcaggactcag

SEQ ID NO: 424561 - DNA, 32 bp, Artificial Sequence
  Description of Artificial Sequence: Synthetic oligonucleotide
atccggactcaagaagttctcaggactcagag

SEQ ID NO: 424562 - DNA, 31 bp, Artificial Sequence
  Description of Artificial Sequence: Synthetic oligonucleotide
tccggactcaagaagttctcaggactcagag

SEQ ID NO: 424563 - DNA, 30 bp, Artificial Sequence
  Description of Artificial Sequence: Synthetic oligonucleotide
ccggactcaagaagttctcaggactcagag

SEQ ID NO: 424564 - DNA, 30 bp, Artificial Sequence
  Description of Artificial Sequence: Synthetic oligonucleotide
cggactcaagaagttctcaggactcagagg

SEQ ID NO: 424565 - DNA, 30 bp, Artificial Sequence
  Description of Artificial Sequence: Synthetic oligonucleotide
ggactcaagaagttctcaggactcagaggc

SEQ ID NO: 424566 - DNA, 31 bp, Artificial Sequence
  Description of Artificial Sequence: Synthetic oligonucleotide
gactcaagaagttctcaggactcagaggctg

SEQ ID NO: 424567 - DNA, 31 bp, Artificial Sequence
  Description of Artificial Sequence: Synthetic oligonucleotide
actcaagaagttctcaggactcagaggctgg

SEQ ID NO: 424568 - DNA, 30 bp, Artificial Sequence
  Description of Artificial Sequence: Synthetic oligonucleotide
ctcaagaagttctcaggactcagaggctgg

SEQ ID NO: 424569 - DNA, 30 bp, Artificial Sequence
  Description of Artificial Sequence: Synthetic oligonucleotide
tcaagaagttctcaggactcagaggctggg

SEQ ID NO: 424570 - DNA, 29 bp, Artificial Sequence
  Description of Artificial Sequence: Synthetic oligonucleotide
caagaagttctcaggactcagaggctggg

SEQ ID NO: 424571 - DNA, 31 bp, Artificial Sequence
  Description of Artificial Sequence: Synthetic oligonucleotide
aagaagttctcaggactcagaggctgggatc

SEQ ID NO: 424572 - DNA, 30 bp, Artificial Sequence
  Description of Artificial Sequence: Synthetic oligonucleotide
agaagttctcaggactcagaggctgggatc

SEQ ID NO: 424573 - DNA, 29 bp, Artificial Sequence
  Description of Artificial Sequence: Synthetic oligonucleotide
gaagttctcaggactcagaggctgggatc

SEQ ID NO: 424574 - DNA, 31 bp, Artificial Sequence
  Description of Artificial Sequence: Synthetic oligonucleotide
aagttctcaggactcagaggctgggatcatg

SEQ ID NO: 424575 - DNA, 30 bp, Artificial Sequence
  Description of Artificial Sequence: Synthetic oligonucleotide
agttctcaggactcagaggctgggatcatg

SEQ ID NO: 424576 - DNA, 29 bp, Artificial Sequence
  Description of Artificial Sequence: Synthetic oligonucleotide
gttctcaggactcagaggctgggatcatg

SEQ ID NO: 424577 - DNA, 29 bp, Artificial Sequence
  Description of Artificial Sequence: Synthetic oligonucleotide
ttctcaggactcagaggctgggatcatgg

SEQ ID NO: 424578 - DNA, 28 bp, Artificial Sequence
  Description of Artificial Sequence: Synthetic oligonucleotide
tctcaggactcagaggctgggatcatgg

SEQ ID NO: 424579 - DNA, 27 bp, Artificial Sequence
  Description of Artificial Sequence: Synthetic oligonucleotide
ctcaggactcagaggctgggatcatgg

SEQ ID NO: 424580 - DNA, 29 bp, Artificial Sequence
  Description of Artificial Sequence: Synthetic oligonucleotide
tcaggactcagaggctgggatcatggtag

SEQ ID NO: 424581 - DNA, 28 bp, Artificial Sequence
  Description of Artificial Sequence: Synthetic oligonucleotide
caggactcagaggctgggatcatggtag

SEQ ID NO: 424582 - DNA, 30 bp, Artificial Sequence
  Description of Artificial Sequence: Synthetic oligonucleotide
aggactcagaggctgggatcatggtagatg

SEQ ID NO: 424583 - DNA, 29 bp, Artificial Sequence
  Description of Artificial Sequence: Synthetic oligonucleotide
ggactcagaggctgggatcatggtagatg

SEQ ID NO: 424584 - DNA, 29 bp, Artificial Sequence
  Description of Artificial Sequence: Synthetic oligonucleotide
gactcagaggctgggatcatggtagatgg

SEQ ID NO: 424585 - DNA, 31 bp, Artificial Sequence
  Description of Artificial Sequence: Synthetic oligonucleotide
actcagaggctgggatcatggtagatggaac

SEQ ID NO: 424586 - DNA, 30 bp, Artificial Sequence
  Description of Artificial Sequence: Synthetic oligonucleotide
ctcagaggctgggatcatggtagatggaac

SEQ ID NO: 424587 - DNA, 30 bp, Artificial Sequence
  Description of Artificial Sequence: Synthetic oligonucleotide
tcagaggctgggatcatggtagatggaacc

SEQ ID NO: 424588 - DNA, 29 bp, Artificial Sequence
  Description of Artificial Sequence: Synthetic oligonucleotide
cagaggctgggatcatggtagatggaacc

SEQ ID NO: 424589 - DNA, 29 bp, Artificial Sequence
  Description of Artificial Sequence: Synthetic oligonucleotide
agaggctgggatcatggtagatggaaccc

SEQ ID NO: 424590 - DNA, 28 bp, Artificial Sequence
  Description of Artificial Sequence: Synthetic oligonucleotide
gaggctgggatcatggtagatggaaccc

SEQ ID NO: 424591 - DNA, 29 bp, Artificial Sequence
  Description of Artificial Sequence: Synthetic oligonucleotide
aggctgggatcatggtagatggaaccctc

SEQ ID NO: 424592 - DNA, 28 bp, Artificial Sequence
  Description of Artificial Sequence: Synthetic oligonucleotide
ggctgggatcatggtagatggaaccctc

SEQ ID NO: 424593 - DNA, 28 bp, Artificial Sequence
  Description of Artificial Sequence: Synthetic oligonucleotide
gctgggatcatggtagatggaaccctcc

SEQ ID NO: 424594 - DNA, 33 bp, Artificial Sequence
  Description of Artificial Sequence: Synthetic oligonucleotide
ctgggatcatggtagatggaaccctccttttac

SEQ ID NO: 424595 - DNA, 34 bp, Artificial Sequence
  Description of Artificial Sequence: Synthetic oligonucleotide
tgggatcatggtagatggaaccctccttttactc

SEQ ID NO: 424596 - DNA, 33 bp, Artificial Sequence
  Description of Artificial Sequence: Synthetic oligonucleotide
gggatcatggtagatggaaccctccttttactc

SEQ ID NO: 424597 - DNA, 33 bp, Artificial Sequence
  Description of Artificial Sequence: Synthetic oligonucleotide
ggatcatggtagatggaaccctccttttactcc

SEQ ID NO: 424598 - DNA, 34 bp, Artificial Sequence
  Description of Artificial Sequence: Synthetic oligonucleotide
gatcatggtagatggaaccctccttttactcctc

SEQ ID NO: 424599 - DNA, 35 bp, Artificial Sequence
  Description of Artificial Sequence: Synthetic oligonucleotide
atcatggtagatggaaccctccttttactcctctc

SEQ ID NO: 424600 - DNA, 34 bp, Artificial Sequence
  Description of Artificial Sequence: Synthetic oligonucleotide
tcatggtagatggaaccctccttttactcctctc

SEQ ID NO: 424601 - DNA, 33 bp, Artificial Sequence
  Description of Artificial Sequence: Synthetic oligonucleotide
catggtagatggaaccctccttttactcctctc

SEQ ID NO: 424602 - DNA, 33 bp, Artificial Sequence; identical to SEQ ID NO: 75521
  Description of Artificial Sequence: Synthetic oligonucleotide

SEQ ID NO: 424603 - DNA, 32 bp, Artificial Sequence; identical to SEQ ID NO: 75522
  Description of Artificial Sequence: Synthetic oligonucleotide

SEQ ID NO: 424604 - DNA, 31 bp, Artificial Sequence; identical to SEQ ID NO: 75523
  Description of Artificial Sequence: Synthetic oligonucleotide

SEQ ID NO: 424605 - DNA, 31 bp, Artificial Sequence; identical to SEQ ID NO: 75524
  Description of Artificial Sequence: Synthetic oligonucleotide

SEQ ID NO: 424606 - DNA, 32 bp, Artificial Sequence; identical to SEQ ID NO: 75525
  Description of Artificial Sequence: Synthetic oligonucleotide

SEQ ID NO: 424607 - DNA, 31 bp, Artificial Sequence; identical to SEQ ID NO: 75526
  Description of Artificial Sequence: Synthetic oligonucleotide

SEQ ID NO: 424608 - DNA, 30 bp, Artificial Sequence; identical to SEQ ID NO: 75527
  Description of Artificial Sequence: Synthetic oligonucleotide

SEQ ID NO: 424609 - DNA, 30 bp, Artificial Sequence; identical to SEQ ID NO: 75528
  Description of Artificial Sequence: Synthetic oligonucleotide

SEQ ID NO: 424610 - DNA, 29 bp, Artificial Sequence
  Description of Artificial Sequence: Synthetic oligonucleotide
tggaaccctccttttactcctctcggagg

SEQ ID NO: 424611 - DNA, 28 bp, Artificial Sequence
  Description of Artificial Sequence: Synthetic oligonucleotide
ggaaccctccttttactcctctcggagg

SEQ ID NO: 424612 - DNA, 28 bp, Artificial Sequence
  Description of Artificial Sequence: Synthetic oligonucleotide
gaaccctccttttactcctctcggaggc

SEQ ID NO: 424613 - DNA, 28 bp, Artificial Sequence
  Description of Artificial Sequence: Synthetic oligonucleotide
aaccctccttttactcctctcggaggcc

SEQ ID NO: 424614 - DNA, 27 bp, Artificial Sequence
  Description of Artificial Sequence: Synthetic oligonucleotide
accctccttttactcctctcggaggcc

SEQ ID NO: 424615 - DNA, 26 bp, Artificial Sequence
  Description of Artificial Sequence: Synthetic oligonucleotide
ccctccttttactcctctcggaggcc

SEQ ID NO: 424616 - DNA, 27 bp, Artificial Sequence
  Description of Artificial Sequence: Synthetic oligonucleotide
cctccttttactcctctcggaggccct

SEQ ID NO: 424617 - DNA, 27 bp, Artificial Sequence
  Description of Artificial Sequence: Synthetic oligonucleotide
ctccttttactcctctcggaggccctg

SEQ ID NO: 424618 - DNA, 27 bp, Artificial Sequence
  Description of Artificial Sequence: Synthetic oligonucleotide
tccttttactcctctcggaggccctgg

SEQ ID NO: 424619 - DNA, 26 bp, Artificial Sequence
  Description of Artificial Sequence: Synthetic oligonucleotide
ccttttactcctctcggaggccctgg

SEQ ID NO: 424620 - DNA, 26 bp, Artificial Sequence
  Description of Artificial Sequence: Synthetic oligonucleotide
cttttactcctctcggaggccctggc

SEQ ID NO: 424621 - DNA, 26 bp, Artificial Sequence
  Description of Artificial Sequence: Synthetic oligonucleotide
ttttactcctctcggaggccctggcc

SEQ ID NO: 424622 - DNA, 25 bp, Artificial Sequence
  Description of Artificial Sequence: Synthetic oligonucleotide
tttactcctctcggaggccctggcc

SEQ ID NO: 424623 - DNA, 24 bp, Artificial Sequence
  Description of Artificial Sequence: Synthetic oligonucleotide
ttactcctctcggaggccctggcc

SEQ ID NO: 424624 - DNA, 23 bp, Artificial Sequence
  Description of Artificial Sequence: Synthetic oligonucleotide
tactcctctcggaggccctggcc

SEQ ID NO: 424625 - DNA, 22 bp, Artificial Sequence
  Description of Artificial Sequence: Synthetic oligonucleotide
actcctctcggaggccctggcc

SEQ ID NO: 424626 - DNA, 21 bp, Artificial Sequence
  Description of Artificial Sequence: Synthetic oligonucleotide
ctcctctcggaggccctggcc

SEQ ID NO: 424627 - DNA, 24 bp, Artificial Sequence
  Description of Artificial Sequence: Synthetic oligonucleotide
tcctctcggaggccctggccctta

SEQ ID NO: 424628 - DNA, 23 bp, Artificial Sequence
  Description of Artificial Sequence: Synthetic oligonucleotide
cctctcggaggccctggccctta

SEQ ID NO: 424629 - DNA, 23 bp, Artificial Sequence
  Description of Artificial Sequence: Synthetic oligonucleotide
ctctcggaggccctggcccttac

SEQ ID NO: 424630 - DNA, 23 bp, Artificial Sequence
  Description of Artificial Sequence: Synthetic oligonucleotide
tctcggaggccctggcccttacc

SEQ ID NO: 424631 - DNA, 22 bp, Artificial Sequence
  Description of Artificial Sequence: Synthetic oligonucleotide
ctcggaggccctggcccttacc

SEQ ID NO: 424632 - DNA, 23 bp, Artificial Sequence
  Description of Artificial Sequence: Synthetic oligonucleotide
tcggaggccctggcccttaccca

SEQ ID NO: 424633 - DNA, 22 bp, Artificial Sequence
  Description of Artificial Sequence: Synthetic oligonucleotide
cggaggccctggcccttaccca

SEQ ID NO: 424634 - DNA, 23 bp, Artificial Sequence
  Description of Artificial Sequence: Synthetic oligonucleotide
ggaggccctggcccttacccaga

SEQ ID NO: 424635 - DNA, 23 bp, Artificial Sequence
  Description of Artificial Sequence: Synthetic oligonucleotide
gaggccctggcccttacccagac

SEQ ID NO: 424636 - DNA, 24 bp, Artificial Sequence
  Description of Artificial Sequence: Synthetic oligonucleotide
aggccctggcccttacccagacct

SEQ ID NO: 424637 - DNA, 23 bp, Artificial Sequence
  Description of Artificial Sequence: Synthetic oligonucleotide
ggccctggcccttacccagacct

SEQ ID NO: 424638 - DNA, 23 bp, Artificial Sequence
  Description of Artificial Sequence: Synthetic oligonucleotide
gccctggcccttacccagacctg

SEQ ID NO: 424639 - DNA, 23 bp, Artificial Sequence
  Description of Artificial Sequence: Synthetic oligonucleotide
ccctggcccttacccagacctgg

SEQ ID NO: 424640 - DNA, 23 bp, Artificial Sequence
  Description of Artificial Sequence: Synthetic oligonucleotide
cctggcccttacccagacctggg

SEQ ID NO: 424641 - DNA, 23 bp, Artificial Sequence
  Description of Artificial Sequence: Synthetic oligonucleotide
ctggcccttacccagacctgggc

SEQ ID NO: 424642 - DNA, 23 bp, Artificial Sequence
  Description of Artificial Sequence: Synthetic oligonucleotide
tggcccttacccagacctgggcg

SEQ ID NO: 424643 - DNA, 22 bp, Artificial Sequence
  Description of Artificial Sequence: Synthetic oligonucleotide
ggcccttacccagacctgggcg

SEQ ID NO: 424644 - DNA, 22 bp, Artificial Sequence
  Description of Artificial Sequence: Synthetic oligonucleotide
gcccttacccagacctgggcgg

SEQ ID NO: 424645 - DNA, 22 bp, Artificial Sequence
  Description of Artificial Sequence: Synthetic oligonucleotide
cccttacccagacctgggcggg

SEQ ID NO: 424646 - DNA, 23 bp, Artificial Sequence
  Description of Artificial Sequence: Synthetic oligonucleotide
ccttacccagacctgggcgggct

SEQ ID NO: 424647 - DNA, 23 bp, Artificial Sequence
  Description of Artificial Sequence: Synthetic oligonucleotide
cttacccagacctgggcgggctc

SEQ ID NO: 424648 - DNA, 23 bp, Artificial Sequence
  Description of Artificial Sequence: Synthetic oligonucleotide
ttacccagacctgggcgggctcc

SEQ ID NO: 424649 - DNA, 22 bp, Artificial Sequence
  Description of Artificial Sequence: Synthetic oligonucleotide
tacccagacctgggcgggctcc

SEQ ID NO: 424650 - DNA, 23 bp, Artificial Sequence
  Description of Artificial Sequence: Synthetic oligonucleotide
acctgggcgggctcccactcctt

SEQ ID NO: 424651 - DNA, 22 bp, Artificial Sequence
  Description of Artificial Sequence: Synthetic oligonucleotide
cctgggcgggctcccactcctt

SEQ ID NO: 424652 - DNA, 24 bp, Artificial Sequence
  Description of Artificial Sequence: Synthetic oligonucleotide
ctgggcgggctcccactccttgaa

SEQ ID NO: 424653 - DNA, 27 bp, Artificial Sequence
  Description of Artificial Sequence: Synthetic oligonucleotide
tgggcgggctcccactccttgaagtat

SEQ ID NO: 424654 - DNA, 27 bp, Artificial Sequence
  Description of Artificial Sequence: Synthetic oligonucleotide
gggcgggctcccactccttgaagtatt

SEQ ID NO: 424655 - DNA, 28 bp, Artificial Sequence
  Description of Artificial Sequence: Synthetic oligonucleotide
ggcgggctcccactccttgaagtatttc

SEQ ID NO: 424656 - DNA, 28 bp, Artificial Sequence
  Description of Artificial Sequence: Synthetic oligonucleotide
gcgggctcccactccttgaagtatttcc

SEQ ID NO: 424657 - DNA, 29 bp, Artificial Sequence
  Description of Artificial Sequence: Synthetic oligonucleotide
cgggctcccactccttgaagtatttccac

SEQ ID NO: 424658 - DNA, 30 bp, Artificial Sequence; identical to SEQ ID NO: 75577
  Description of Artificial Sequence: Synthetic oligonucleotide

SEQ ID NO: 424659 - DNA, 32 bp, Artificial Sequence; identical to SEQ ID NO: 75578
  Description of Artificial Sequence: Synthetic oligonucleotide

SEQ ID NO: 424660 - DNA, 32 bp, Artificial Sequence; identical to SEQ ID NO: 75579
  Description of Artificial Sequence: Synthetic oligonucleotide

SEQ ID NO: 424661 - DNA, 32 bp, Artificial Sequence; identical to SEQ ID NO: 75580
  Description of Artificial Sequence: Synthetic oligonucleotide

SEQ ID NO: 424662 - DNA, 33 bp, Artificial Sequence; identical to SEQ ID NO: 75581
  Description of Artificial Sequence: Synthetic oligonucleotide

SEQ ID NO: 424663 - DNA, 32 bp, Artificial Sequence; identical to SEQ ID NO: 75582
  Description of Artificial Sequence: Synthetic oligonucleotide

SEQ ID NO: 424664 - DNA, 33 bp, Artificial Sequence; identical to SEQ ID NO: 75583
  Description of Artificial Sequence: Synthetic oligonucleotide

SEQ ID NO: 424665 - DNA, 33 bp, Artificial Sequence; identical to SEQ ID NO: 75584
  Description of Artificial Sequence: Synthetic oligonucleotide

SEQ ID NO: 424666 - DNA, 33 bp, Artificial Sequence; identical to SEQ ID NO: 75585
  Description of Artificial Sequence: Synthetic oligonucleotide

SEQ ID NO: 424667 - DNA, 32 bp, Artificial Sequence; identical to SEQ ID NO: 75586
  Description of Artificial Sequence: Synthetic oligonucleotide

SEQ ID NO: 424668 - DNA, 32 bp, Artificial Sequence; identical to SEQ ID NO: 75587
  Description of Artificial Sequence: Synthetic oligonucleotide

SEQ ID NO: 424669 - DNA, 31 bp, Artificial Sequence; identical to SEQ ID NO: 75588
  Description of Artificial Sequence: Synthetic oligonucleotide

SEQ ID NO: 424670 - DNA, 31 bp, Artificial Sequence; identical to SEQ ID NO: 75589
  Description of Artificial Sequence: Synthetic oligonucleotide

SEQ ID NO: 424671 - DNA, 31 bp, Artificial Sequence; identical to SEQ ID NO: 75590
  Description of Artificial Sequence: Synthetic oligonucleotide

SEQ ID NO: 424672 - DNA, 30 bp, Artificial Sequence; identical to SEQ ID NO: 75591
  Description of Artificial Sequence: Synthetic oligonucleotide

SEQ ID NO: 424673 - DNA, 29 bp, Artificial Sequence
  Description of Artificial Sequence: Synthetic oligonucleotide
gaagtatttccacacttccgtgtcccggc

SEQ ID NO: 424674 - DNA, 29 bp, Artificial Sequence
  Description of Artificial Sequence: Synthetic oligonucleotide
aagtatttccacacttccgtgtcccggcc

SEQ ID NO: 424675 - DNA, 28 bp, Artificial Sequence
  Description of Artificial Sequence: Synthetic oligonucleotide
agtatttccacacttccgtgtcccggcc

SEQ ID NO: 424676 - DNA, 27 bp, Artificial Sequence
  Description of Artificial Sequence: Synthetic oligonucleotide
gtatttccacacttccgtgtcccggcc

SEQ ID NO: 424677 - DNA, 27 bp, Artificial Sequence
  Description of Artificial Sequence: Synthetic oligonucleotide
tatttccacacttccgtgtcccggccc

SEQ ID NO: 424678 - DNA, 26 bp, Artificial Sequence
  Description of Artificial Sequence: Synthetic oligonucleotide
atttccacacttccgtgtcccggccc

SEQ ID NO: 424679 - DNA, 25 bp, Artificial Sequence
  Description of Artificial Sequence: Synthetic oligonucleotide
tttccacacttccgtgtcccggccc

SEQ ID NO: 424680 - DNA, 24 bp, Artificial Sequence
  Description of Artificial Sequence: Synthetic oligonucleotide
ttccacacttccgtgtcccggccc

SEQ ID NO: 424681 - DNA, 23 bp, Artificial Sequence
  Description of Artificial Sequence: Synthetic oligonucleotide
tccacacttccgtgtcccggccc

SEQ ID NO: 424682 - DNA, 22 bp, Artificial Sequence
  Description of Artificial Sequence: Synthetic oligonucleotide
ccacacttccgtgtcccggccc

SEQ ID NO: 424683 - DNA, 22 bp, Artificial Sequence
  Description of Artificial Sequence: Synthetic oligonucleotide
cacacttccgtgtcccggcccg

SEQ ID NO: 424684 - DNA, 23 bp, Artificial Sequence
  Description of Artificial Sequence: Synthetic oligonucleotide
gcggggagccccgcttcatctct

SEQ ID NO: 424685 - DNA, 24 bp, Artificial Sequence
  Description of Artificial Sequence: Synthetic oligonucleotide
cggggagccccgcttcatctctgt

SEQ ID NO: 424686 - DNA, 24 bp, Artificial Sequence
  Description of Artificial Sequence: Synthetic oligonucleotide
ggggagccccgcttcatctctgtg

SEQ ID NO: 424687 - DNA, 24 bp, Artificial Sequence
  Description of Artificial Sequence: Synthetic oligonucleotide
gggagccccgcttcatctctgtgg

SEQ ID NO: 424688 - DNA, 24 bp, Artificial Sequence
  Description of Artificial Sequence: Synthetic oligonucleotide
ggagccccgcttcatctctgtggg

SEQ ID NO: 424689 - DNA, 26 bp, Artificial Sequence
  Description of Artificial Sequence: Synthetic oligonucleotide
gagccccgcttcatctctgtgggcta

SEQ ID NO: 424690 - DNA, 26 bp, Artificial Sequence
  Description of Artificial Sequence: Synthetic oligonucleotide
agccccgcttcatctctgtgggctac

SEQ ID NO: 424691 - DNA, 25 bp, Artificial Sequence
  Description of Artificial Sequence: Synthetic oligonucleotide
gccccgcttcatctctgtgggctac

SEQ ID NO: 424692 - DNA, 26 bp, Artificial Sequence
  Description of Artificial Sequence: Synthetic oligonucleotide
ccccgcttcatctctgtgggctacgt

SEQ ID NO: 424693 - DNA, 26 bp, Artificial Sequence
  Description of Artificial Sequence: Synthetic oligonucleotide
cccgcttcatctctgtgggctacgtg

SEQ ID NO: 424694 - DNA, 27 bp, Artificial Sequence
  Description of Artificial Sequence: Synthetic oligonucleotide
ccgcttcatctctgtgggctacgtgga

SEQ ID NO: 424695 - DNA, 27 bp, Artificial Sequence
  Description of Artificial Sequence: Synthetic oligonucleotide
cgcttcatctctgtgggctacgtggac

SEQ ID NO: 424696 - DNA, 27 bp, Artificial Sequence
  Description of Artificial Sequence: Synthetic oligonucleotide
gcttcatctctgtgggctacgtggacg

SEQ ID NO: 424697 - DNA, 28 bp, Artificial Sequence
  Description of Artificial Sequence: Synthetic oligonucleotide
cttcatctctgtgggctacgtggacgac

SEQ ID NO: 424698 - DNA, 29 bp, Artificial Sequence
  Description of Artificial Sequence: Synthetic oligonucleotide
ttcatctctgtgggctacgtggacgacac

SEQ ID NO: 424699 - DNA, 28 bp, Artificial Sequence
  Description of Artificial Sequence: Synthetic oligonucleotide
tcatctctgtgggctacgtggacgacac

SEQ ID NO: 424700 - DNA, 27 bp, Artificial Sequence
  Description of Artificial Sequence: Synthetic oligonucleotide
catctctgtgggctacgtggacgacac

SEQ ID NO: 424701 - DNA, 27 bp, Artificial Sequence
  Description of Artificial Sequence: Synthetic oligonucleotide
atctctgtgggctacgtggacgacacc

SEQ ID NO: 424702 - DNA, 26 bp, Artificial Sequence
  Description of Artificial Sequence: Synthetic oligonucleotide
tctctgtgggctacgtggacgacacc

SEQ ID NO: 424703 - DNA, 25 bp, Artificial Sequence
  Description of Artificial Sequence: Synthetic oligonucleotide
ctctgtgggctacgtggacgacacc

SEQ ID NO: 424704 - DNA, 26 bp, Artificial Sequence
  Description of Artificial Sequence: Synthetic oligonucleotide
tctgtgggctacgtggacgacaccca

SEQ ID NO: 424705 - DNA, 25 bp, Artificial Sequence
  Description of Artificial Sequence: Synthetic oligonucleotide
ctgtgggctacgtggacgacaccca

SEQ ID NO: 424706 - DNA, 27 bp, Artificial Sequence
  Description of Artificial Sequence: Synthetic oligonucleotide
tgtgggctacgtggacgacacccagtt

SEQ ID NO: 424707 - DNA, 26 bp, Artificial Sequence
  Description of Artificial Sequence: Synthetic oligonucleotide
gtggacgacacccagttcgtgcgctt

SEQ ID NO: 424708 - DNA, 26 bp, Artificial Sequence
  Description of Artificial Sequence: Synthetic oligonucleotide
tggacgacacccagttcgtgcgcttc

SEQ ID NO: 424709 - DNA, 25 bp, Artificial Sequence
  Description of Artificial Sequence: Synthetic oligonucleotide
ggacgacacccagttcgtgcgcttc

SEQ ID NO: 424710 - DNA, 26 bp, Artificial Sequence
  Description of Artificial Sequence: Synthetic oligonucleotide
gacgacacccagttcgtgcgcttcga

SEQ ID NO: 424711 - DNA, 27 bp, Artificial Sequence
  Description of Artificial Sequence: Synthetic oligonucleotide
acgacacccagttcgtgcgcttcgaca

SEQ ID NO: 424712 - DNA, 27 bp, Artificial Sequence
  Description of Artificial Sequence: Synthetic oligonucleotide
cgacacccagttcgtgcgcttcgacaa

SEQ ID NO: 424713 - DNA, 27 bp, Artificial Sequence
  Description of Artificial Sequence: Synthetic oligonucleotide
gacacccagttcgtgcgcttcgacaac

SEQ ID NO: 424714 - DNA, 27 bp, Artificial Sequence
  Description of Artificial Sequence: Synthetic oligonucleotide
acacccagttcgtgcgcttcgacaacg

SEQ ID NO: 424715 - DNA, 27 bp, Artificial Sequence
  Description of Artificial Sequence: Synthetic oligonucleotide
cacccagttcgtgcgcttcgacaacga

SEQ ID NO: 424716 - DNA, 27 bp, Artificial Sequence
  Description of Artificial Sequence: Synthetic oligonucleotide
acccagttcgtgcgcttcgacaacgac

SEQ ID NO: 424717 - DNA, 26 bp, Artificial Sequence
  Description of Artificial Sequence: Synthetic oligonucleotide
cccagttcgtgcgcttcgacaacgac

SEQ ID NO: 424718 - DNA, 26 bp, Artificial Sequence
  Description of Artificial Sequence: Synthetic oligonucleotide
ccagttcgtgcgcttcgacaacgacg

SEQ ID NO: 424719 - DNA, 26 bp, Artificial Sequence
  Description of Artificial Sequence: Synthetic oligonucleotide
cagttcgtgcgcttcgacaacgacgc

SEQ ID NO: 424720 - DNA, 26 bp, Artificial Sequence
  Description of Artificial Sequence: Synthetic oligonucleotide
agttcgtgcgcttcgacaacgacgcc

SEQ ID NO: 424721 - DNA, 25 bp, Artificial Sequence
  Description of Artificial Sequence: Synthetic oligonucleotide
gttcgtgcgcttcgacaacgacgcc

SEQ ID NO: 424722 - DNA, 25 bp, Artificial Sequence
  Description of Artificial Sequence: Synthetic oligonucleotide
ttcgtgcgcttcgacaacgacgccg

SEQ ID NO: 424723 - DNA, 24 bp, Artificial Sequence
  Description of Artificial Sequence: Synthetic oligonucleotide
tcgtgcgcttcgacaacgacgccg

SEQ ID NO: 424724 - DNA, 23 bp, Artificial Sequence
  Description of Artificial Sequence: Synthetic oligonucleotide
cgtgcgcttcgacaacgacgccg

SEQ ID NO: 424725 - DNA, 23 bp, Artificial Sequence
  Description of Artificial Sequence: Synthetic oligonucleotide
gtgcgcttcgacaacgacgccgc

SEQ ID NO: 424726 - DNA, 24 bp, Artificial Sequence
  Description of Artificial Sequence: Synthetic oligonucleotide
tgcgcttcgacaacgacgccgcga

SEQ ID NO: 424727 - DNA, 23 bp, Artificial Sequence
  Description of Artificial Sequence: Synthetic oligonucleotide
gcgcttcgacaacgacgccgcga

SEQ ID NO: 424728 - DNA, 24 bp, Artificial Sequence
  Description of Artificial Sequence: Synthetic oligonucleotide
cgcttcgacaacgacgccgcgagt

SEQ ID NO: 424729 - DNA, 24 bp, Artificial Sequence
  Description of Artificial Sequence: Synthetic oligonucleotide
gcttcgacaacgacgccgcgagtc

SEQ ID NO: 424730 - DNA, 24 bp, Artificial Sequence
  Description of Artificial Sequence: Synthetic oligonucleotide
cttcgacaacgacgccgcgagtcc

SEQ ID NO: 424731 - DNA, 25 bp, Artificial Sequence
  Description of Artificial Sequence: Synthetic oligonucleotide
ttcgacaacgacgccgcgagtccga

SEQ ID NO: 424732 - DNA, 24 bp, Artificial Sequence
  Description of Artificial Sequence: Synthetic oligonucleotide
tcgacaacgacgccgcgagtccga

SEQ ID NO: 424733 - DNA, 23 bp, Artificial Sequence
  Description of Artificial Sequence: Synthetic oligonucleotide
cgacaacgacgccgcgagtccga

SEQ ID NO: 424734 - DNA, 23 bp, Artificial Sequence
  Description of Artificial Sequence: Synthetic oligonucleotide
gacaacgacgccgcgagtccgag

SEQ ID NO: 424735 - DNA, 25 bp, Artificial Sequence
  Description of Artificial Sequence: Synthetic oligonucleotide
acaacgacgccgcgagtccgaggat

SEQ ID NO: 424736 - DNA, 24 bp, Artificial Sequence
  Description of Artificial Sequence: Synthetic oligonucleotide
caacgacgccgcgagtccgaggat

SEQ ID NO: 424737 - DNA, 24 bp, Artificial Sequence
  Description of Artificial Sequence: Synthetic oligonucleotide
aacgacgccgcgagtccgaggatg

SEQ ID NO: 424738 - DNA, 23 bp, Artificial Sequence
  Description of Artificial Sequence: Synthetic oligonucleotide
acgacgccgcgagtccgaggatg

SEQ ID NO: 424739 - DNA, 23 bp, Artificial Sequence
  Description of Artificial Sequence: Synthetic oligonucleotide
gacgccgcgagtccgaggatggt

SEQ ID NO: 424740 - DNA, 23 bp, Artificial Sequence
  Description of Artificial Sequence: Synthetic oligonucleotide
acgccgcgagtccgaggatggtg

SEQ ID NO: 424741 - DNA, 22 bp, Artificial Sequence
  Description of Artificial Sequence: Synthetic oligonucleotide
cgccgcgagtccgaggatggtg

SEQ ID NO: 424742 - DNA, 22 bp, Artificial Sequence
  Description of Artificial Sequence: Synthetic oligonucleotide
gccgcgagtccgaggatggtgc

SEQ ID NO: 424743 - DNA, 22 bp, Artificial Sequence
  Description of Artificial Sequence: Synthetic oligonucleotide
ccgcgagtccgaggatggtgcc

SEQ ID NO: 424744 - DNA, 22 bp, Artificial Sequence
  Description of Artificial Sequence: Synthetic oligonucleotide
cgcgagtccgaggatggtgccg

SEQ ID NO: 424745 - DNA, 22 bp, Artificial Sequence
  Description of Artificial Sequence: Synthetic oligonucleotide
gcgagtccgaggatggtgccgc

SEQ ID NO: 424746 - DNA, 22 bp, Artificial Sequence
  Description of Artificial Sequence: Synthetic oligonucleotide
cgagtccgaggatggtgccgcg

SEQ ID NO: 424747 - DNA, 22 bp, Artificial Sequence
  Description of Artificial Sequence: Synthetic oligonucleotide
gagtccgaggatggtgccgcgg

SEQ ID NO: 424748 - DNA, 22 bp, Artificial Sequence
  Description of Artificial Sequence: Synthetic oligonucleotide
agtccgaggatggtgccgcggg

SEQ ID NO: 424749 - DNA, 21 bp, Artificial Sequence
  Description of Artificial Sequence: Synthetic oligonucleotide
gtccgaggatggtgccgcggg

SEQ ID NO: 424750 - DNA, 21 bp, Artificial Sequence
  Description of Artificial Sequence: Synthetic oligonucleotide
tccgaggatggtgccgcgggc

SEQ ID NO: 424751 - DNA, 20 bp, Artificial Sequence
  Description of Artificial Sequence: Synthetic oligonucleotide
ccgaggatggtgccgcgggc

SEQ ID NO: 424752 - DNA, 20 bp, Artificial Sequence
  Description of Artificial Sequence: Synthetic oligonucleotide
cgaggatggtgccgcgggcg

SEQ ID NO: 424753 - DNA, 20 bp, Artificial Sequence
  Description of Artificial Sequence: Synthetic oligonucleotide
gaggatggtgccgcgggcgc

SEQ ID NO: 424754 - DNA, 20 bp, Artificial Sequence
  Description of Artificial Sequence: Synthetic oligonucleotide
aggatggtgccgcgggcgcc

SEQ ID NO: 424755 - DNA, 20 bp, Artificial Sequence
  Description of Artificial Sequence: Synthetic oligonucleotide
ggatggtgccgcgggcgcct

SEQ ID NO: 424756 - DNA, 20 bp, Artificial Sequence
  Description of Artificial Sequence: Synthetic oligonucleotide
gatggtgccgcgggcgccgt

SEQ ID NO: 424757 - DNA, 20 bp, Artificial Sequence
  Description of Artificial Sequence: Synthetic oligonucleotide
atggtgccgcgggcgccgtg

SEQ ID NO: 424758 - DNA, 20 bp, Artificial Sequence
  Description of Artificial Sequence: Synthetic oligonucleotide
tggtgccgcgggcgccgtgt

SEQ ID NO: 424759 - DNA, 20 bp, Artificial Sequence
  Description of Artificial Sequence: Synthetic oligonucleotide
ggtgccgcgggcgccgtgtt

SEQ ID NO: 424760 - DNA, 20 bp, Artificial Sequence
  Description of Artificial Sequence: Synthetic oligonucleotide
gtgccgcgggcgccgtggat

SEQ ID NO: 424761 - DNA, 20 bp, Artificial Sequence
  Description of Artificial Sequence: Synthetic oligonucleotide
tgccgcgggcgccgtggatg

SEQ ID NO: 424762 - DNA, 20 bp, Artificial Sequence
  Description of Artificial Sequence: Synthetic oligonucleotide
gccgcgggcgccgtggatgt

SEQ ID NO: 424763 - DNA, 20 bp, Artificial Sequence
  Description of Artificial Sequence: Synthetic oligonucleotide
ccgcgggcgccgtggatgga

SEQ ID NO: 424764 - DNA, 20 bp, Artificial Sequence
  Description of Artificial Sequence: Synthetic oligonucleotide
cgcgggcgccgtggatggag

SEQ ID NO: 424765 - DNA, 21 bp, Artificial Sequence
  Description of Artificial Sequence: Synthetic oligonucleotide
gcgggcgccgtggatggagca

SEQ ID NO: 424766 - DNA, 21 bp, Artificial Sequence
  Description of Artificial Sequence: Synthetic oligonucleotide
cgggcgccgtggatggagcag

SEQ ID NO: 424767 - DNA, 22 bp, Artificial Sequence
  Description of Artificial Sequence: Synthetic oligonucleotide
gggcgccgtggatggagcagga

SEQ ID NO: 424768 - DNA, 22 bp, Artificial Sequence
  Description of Artificial Sequence: Synthetic oligonucleotide
ggcgccgtggatggagcaggag

SEQ ID NO: 424769 - DNA, 22 bp, Artificial Sequence
  Description of Artificial Sequence: Synthetic oligonucleotide
gcgccgtggatggagcaggagg

SEQ ID NO: 424770 - DNA, 22 bp, Artificial Sequence
  Description of Artificial Sequence: Synthetic oligonucleotide
cgccgtggatggagcaggaggg

SEQ ID NO: 424771 - DNA, 23 bp, Artificial Sequence
  Description of Artificial Sequence: Synthetic oligonucleotide
gccgtggatggagcaggaggggt

SEQ ID NO: 424772 - DNA, 24 bp, Artificial Sequence
  Description of Artificial Sequence: Synthetic oligonucleotide
ccgtggatggagcaggaggggtca

SEQ ID NO: 424773 - DNA, 25 bp, Artificial Sequence
  Description of Artificial Sequence: Synthetic oligonucleotide
cgtggatggagcaggaggggtcaga

SEQ ID NO: 424774 - DNA, 27 bp, Artificial Sequence
  Description of Artificial Sequence: Synthetic oligonucleotide
gtggatggagcaggaggggtcagagta

SEQ ID NO: 424775 - DNA, 29 bp, Artificial Sequence
  Description of Artificial Sequence: Synthetic oligonucleotide
tggatggagcaggaggggtcagagtattg

SEQ ID NO: 424776 - DNA, 28 bp, Artificial Sequence
  Description of Artificial Sequence: Synthetic oligonucleotide
ggatggagcaggaggggtcagagtattg

SEQ ID NO: 424777 - DNA, 28 bp, Artificial Sequence
  Description of Artificial Sequence: Synthetic oligonucleotide
gatggagcaggaggggtcagagtattgg

SEQ ID NO: 424778 - DNA, 28 bp, Artificial Sequence
  Description of Artificial Sequence: Synthetic oligonucleotide
atggagcaggaggggtcagagtattggg

SEQ ID NO: 424779 - DNA, 27 bp, Artificial Sequence
  Description of Artificial Sequence: Synthetic oligonucleotide
tggagcaggaggggtcagagtattggg

SEQ ID NO: 424780 - DNA, 27 bp, Artificial Sequence
  Description of Artificial Sequence: Synthetic oligonucleotide
ggagcaggaggggtcagagtattggga

SEQ ID NO: 424781 - DNA, 27 bp, Artificial Sequence
  Description of Artificial Sequence: Synthetic oligonucleotide
gagcaggaggggtcagagtattgggac

SEQ ID NO: 424782 - DNA, 27 bp, Artificial Sequence
  Description of Artificial Sequence: Synthetic oligonucleotide
agcaggaggggtcagagtattgggacc

SEQ ID NO: 424783 - DNA, 26 bp, Artificial Sequence
  Description of Artificial Sequence: Synthetic oligonucleotide
gcaggaggggtcagagtattgggacc

SEQ ID NO: 424784 - DNA, 26 bp, Artificial Sequence
  Description of Artificial Sequence: Synthetic oligonucleotide
caggaggggtcagagtattgggaccg

SEQ ID NO: 424785 - DNA, 26 bp, Artificial Sequence
  Description of Artificial Sequence: Synthetic oligonucleotide
aggaggggtcagagtattgggaccgg

SEQ ID NO: 424786 - DNA, 25 bp, Artificial Sequence
  Description of Artificial Sequence: Synthetic oligonucleotide
ggaggggtcagagtattgggaccgg

SEQ ID NO: 424787 - DNA, 26 bp, Artificial Sequence
  Description of Artificial Sequence: Synthetic oligonucleotide
gaggggtcagagtattgggaccggga

SEQ ID NO: 424788 - DNA, 27 bp, Artificial Sequence
  Description of Artificial Sequence: Synthetic oligonucleotide
aggggtcagagtattgggaccgggaga

SEQ ID NO: 424789 - DNA, 26 bp, Artificial Sequence
  Description of Artificial Sequence: Synthetic oligonucleotide
ggggtcagagtattgggaccgggaga

SEQ ID NO: 424790 - DNA, 27 bp, Artificial Sequence
  Description of Artificial Sequence: Synthetic oligonucleotide
gggtcagagtattgggaccgggagaca

SEQ ID NO: 424791 - DNA, 27 bp, Artificial Sequence
  Description of Artificial Sequence: Synthetic oligonucleotide
ggtcagagtattgggaccgggagacac

SEQ ID NO: 424792 - DNA, 27 bp, Artificial Sequence
  Description of Artificial Sequence: Synthetic oligonucleotide
gtcagagtattgggaccgggagacacg

SEQ ID NO: 424793 - DNA, 27 bp, Artificial Sequence
  Description of Artificial Sequence: Synthetic oligonucleotide
tcagagtattgggaccgggagacacgg

SEQ ID NO: 424794 - DNA, 27 bp, Artificial Sequence
  Description of Artificial Sequence: Synthetic oligonucleotide
cagagtattgggaccgggagacacgga

SEQ ID NO: 424795 - DNA, 27 bp, Artificial Sequence
  Description of Artificial Sequence: Synthetic oligonucleotide
agagtattgggaccgggagacacggag

SEQ ID NO: 424796 - DNA, 26 bp, Artificial Sequence
  Description of Artificial Sequence: Synthetic oligonucleotide
gagtattgggaccgggagacacggag

SEQ ID NO: 424797 - DNA, 26 bp, Artificial Sequence
  Description of Artificial Sequence: Synthetic oligonucleotide
agtattgggaccgggagacacggagc

SEQ ID NO: 424798 - DNA, 25 bp, Artificial Sequence
  Description of Artificial Sequence: Synthetic oligonucleotide
gtattgggaccgggagacacggagc

SEQ ID NO: 424799 - DNA, 25 bp, Artificial Sequence
  Description of Artificial Sequence: Synthetic oligonucleotide
tattgggaccgggagacacggagcg

SEQ ID NO: 424800 - DNA, 24 bp, Artificial Sequence
  Description of Artificial Sequence: Synthetic oligonucleotide
attgggaccgggagacacggagcg

SEQ ID NO: 424801 - DNA, 23 bp, Artificial Sequence
  Description of Artificial Sequence: Synthetic oligonucleotide
ttgggaccgggagacacggagcg

SEQ ID NO: 424802 - DNA, 22 bp, Artificial Sequence
  Description of Artificial Sequence: Synthetic oligonucleotide
tgggaccgggagacacggagcg

SEQ ID NO: 424803 - DNA, 21 bp, Artificial Sequence
  Description of Artificial Sequence: Synthetic oligonucleotide
gggaccgggagacacggagcg

SEQ ID NO: 424804 - DNA, 21 bp, Artificial Sequence
  Description of Artificial Sequence: Synthetic oligonucleotide
ggaccgggagacacggagcgc

SEQ ID NO: 424805 - DNA, 22 bp, Artificial Sequence
  Description of Artificial Sequence: Synthetic oligonucleotide
gaccgggagacacggagcgcca

SEQ ID NO: 424806 - DNA, 22 bp, Artificial Sequence
  Description of Artificial Sequence: Synthetic oligonucleotide
accgggagacacggagcgccag

SEQ ID NO: 424807 - DNA, 21 bp, Artificial Sequence
  Description of Artificial Sequence: Synthetic oligonucleotide
ccgggagacacggagcgccag

SEQ ID NO: 424808 - DNA, 21 bp, Artificial Sequence
  Description of Artificial Sequence: Synthetic oligonucleotide
cgggagacacggagcgccagg

SEQ ID NO: 424809 - DNA, 22 bp, Artificial Sequence
  Description of Artificial Sequence: Synthetic oligonucleotide
gggagacacggagcgccaggga

SEQ ID NO: 424810 - DNA, 23 bp, Artificial Sequence
  Description of Artificial Sequence: Synthetic oligonucleotide
ggagacacggagcgccagggaca

SEQ ID NO: 424811 - DNA, 23 bp, Artificial Sequence
  Description of Artificial Sequence: Synthetic oligonucleotide
gagacacggagcgccagggacac

SEQ ID NO: 424812 - DNA, 23 bp, Artificial Sequence
  Description of Artificial Sequence: Synthetic oligonucleotide
agacacggagcgccagggacacc

SEQ ID NO: 424813 - DNA, 22 bp, Artificial Sequence
  Description of Artificial Sequence: Synthetic oligonucleotide
gacacggagcgccagggacacc

SEQ ID NO: 424814 - DNA, 22 bp, Artificial Sequence
  Description of Artificial Sequence: Synthetic oligonucleotide
acacggagcgccagggacaccg

SEQ ID NO: 424815 - DNA, 21 bp, Artificial Sequence
  Description of Artificial Sequence: Synthetic oligonucleotide
cacggagcgccagggacaccg

SEQ ID NO: 424816 - DNA, 22 bp, Artificial Sequence
  Description of Artificial Sequence: Synthetic oligonucleotide
acggagcgccagggacaccgca

SEQ ID NO: 424817 - DNA, 21 bp, Artificial Sequence
  Description of Artificial Sequence: Synthetic oligonucleotide
cggagcgccagggacaccgca

SEQ ID NO: 424818 - DNA, 22 bp, Artificial Sequence
  Description of Artificial Sequence: Synthetic oligonucleotide
ggagcgccagggacaccgcaca

SEQ ID NO: 424819 - DNA, 27 bp, Artificial Sequence
  Description of Artificial Sequence: Synthetic oligonucleotide
gagcgccagggacaccgcacagatttt

SEQ ID NO: 424820 - DNA, 27 bp, Artificial Sequence
  Description of Artificial Sequence: Synthetic oligonucleotide
agcgccagggacaccgcacagattttc

SEQ ID NO: 424821 - DNA, 26 bp, Artificial Sequence
  Description of Artificial Sequence: Synthetic oligonucleotide
gcgccagggacaccgcacagattttc

SEQ ID NO: 424822 - DNA, 26 bp, Artificial Sequence
  Description of Artificial Sequence: Synthetic oligonucleotide
cgccagggacaccgcacagattttcc

SEQ ID NO: 424823 - DNA, 27 bp, Artificial Sequence
  Description of Artificial Sequence: Synthetic oligonucleotide
gccagggacaccgcacagattttccga

SEQ ID NO: 424824 - DNA, 27 bp, Artificial Sequence
  Description of Artificial Sequence: Synthetic oligonucleotide
ccagggacaccgcacagattttccgag

SEQ ID NO: 424825 - DNA, 28 bp, Artificial Sequence
  Description of Artificial Sequence: Synthetic oligonucleotide
cagggacaccgcacagattttccgagtg

SEQ ID NO: 424826 - DNA, 30 bp, Artificial Sequence; identical to SEQ ID NO: 75736
  Description of Artificial Sequence: Synthetic oligonucleotide

SEQ ID NO: 424827 - DNA, 29 bp, Artificial Sequence
  Description of Artificial Sequence: Synthetic oligonucleotide
gggacaccgcacagattttccgagtgaac

SEQ ID NO: 424828 - DNA, 29 bp, Artificial Sequence
  Description of Artificial Sequence: Synthetic oligonucleotide
ggacaccgcacagattttccgagtgaacc

SEQ ID NO: 424829 - DNA, 30 bp, Artificial Sequence; identical to SEQ ID NO: 75739
  Description of Artificial Sequence: Synthetic oligonucleotide

SEQ ID NO: 424830 - DNA, 30 bp, Artificial Sequence; identical to SEQ ID NO: 75740
  Description of Artificial Sequence: Synthetic oligonucleotide

SEQ ID NO: 424831 - DNA, 29 bp, Artificial Sequence
  Description of Artificial Sequence: Synthetic oligonucleotide
caccgcacagattttccgagtgaacctgc

SEQ ID NO: 424832 - DNA, 29 bp, Artificial Sequence
  Description of Artificial Sequence: Synthetic oligonucleotide
accgcacagattttccgagtgaacctgcg

SEQ ID NO: 424833 - DNA, 28 bp, Artificial Sequence
  Description of Artificial Sequence: Synthetic oligonucleotide
ccgcacagattttccgagtgaacctgcg

SEQ ID NO: 424834 - DNA, 28 bp, Artificial Sequence
  Description of Artificial Sequence: Synthetic oligonucleotide
cgcacagattttccgagtgaacctgcgg

SEQ ID NO: 424835 - DNA, 29 bp, Artificial Sequence
  Description of Artificial Sequence: Synthetic oligonucleotide
gcacagattttccgagtgaacctgcggac

SEQ ID NO: 424836 - DNA, 29 bp, Artificial Sequence
  Description of Artificial Sequence: Synthetic oligonucleotide
cacagattttccgagtgaacctgcggacg

SEQ ID NO: 424837 - DNA, 29 bp, Artificial Sequence
  Description of Artificial Sequence: Synthetic oligonucleotide
acagattttccgagtgaacctgcggacgc

SEQ ID NO: 424838 - DNA, 28 bp, Artificial Sequence
  Description of Artificial Sequence: Synthetic oligonucleotide
cagattttccgagtgaacctgcggacgc

SEQ ID NO: 424839 - DNA, 29 bp, Artificial Sequence
  Description of Artificial Sequence: Synthetic oligonucleotide
agattttccgagtgaacctgcggacgctg

SEQ ID NO: 424840 - DNA, 28 bp, Artificial Sequence
  Description of Artificial Sequence: Synthetic oligonucleotide
gattttccgagtgaacctgcggacgctg

SEQ ID NO: 424841 - DNA, 28 bp, Artificial Sequence
  Description of Artificial Sequence: Synthetic oligonucleotide
attttccgagtgaacctgcggacgctgc

SEQ ID NO: 424842 - DNA, 27 bp, Artificial Sequence
  Description of Artificial Sequence: Synthetic oligonucleotide
ttttccgagtgaacctgcggacgctgc

SEQ ID NO: 424843 - DNA, 26 bp, Artificial Sequence
  Description of Artificial Sequence: Synthetic oligonucleotide
tttccgagtgaacctgcggacgctgc

SEQ ID NO: 424844 - DNA, 25 bp, Artificial Sequence
  Description of Artificial Sequence: Synthetic oligonucleotide
ttccgagtgaacctgcggacgctgc

SEQ ID NO: 424845 - DNA, 24 bp, Artificial Sequence
  Description of Artificial Sequence: Synthetic oligonucleotide
tccgagtgaacctgcggacgctgc

SEQ ID NO: 424846 - DNA, 23 bp, Artificial Sequence
  Description of Artificial Sequence: Synthetic oligonucleotide
ccgagtgaacctgcggacgctgc

SEQ ID NO: 424847 - DNA, 23 bp, Artificial Sequence
  Description of Artificial Sequence: Synthetic oligonucleotide
cgagtgaacctgcggacgctgcg

SEQ ID NO: 424848 - DNA, 23 bp, Artificial Sequence
  Description of Artificial Sequence: Synthetic oligonucleotide
gagtgaacctgcggacgctgcgc

SEQ ID NO: 424849 - DNA, 23 bp, Artificial Sequence
  Description of Artificial Sequence: Synthetic oligonucleotide
agtgaacctgcggacgctgcgcg

SEQ ID NO: 424850 - DNA, 22 bp, Artificial Sequence
  Description of Artificial Sequence: Synthetic oligonucleotide
gtgaacctgcggacgctgcgcg

SEQ ID NO: 424851 - DNA, 22 bp, Artificial Sequence
  Description of Artificial Sequence: Synthetic oligonucleotide
tgaacctgcggacgctgcgcgg

SEQ ID NO: 424852 - DNA, 21 bp, Artificial Sequence
  Description of Artificial Sequence: Synthetic oligonucleotide
gaacctgcggacgctgcgcgg

SEQ ID NO: 424853 - DNA, 23 bp, Artificial Sequence
  Description of Artificial Sequence: Synthetic oligonucleotide
aacctgcggacgctgcgcggcta

SEQ ID NO: 424854 - DNA, 22 bp, Artificial Sequence
  Description of Artificial Sequence: Synthetic oligonucleotide
acctgcggacgctgcgcggcta

SEQ ID NO: 424855 - DNA, 21 bp, Artificial Sequence
  Description of Artificial Sequence: Synthetic oligonucleotide
cctgcggacgctgcgcggcta

SEQ ID NO: 424856 - DNA, 23 bp, Artificial Sequence
  Description of Artificial Sequence: Synthetic oligonucleotide
ctgcggacgctgcgcggctacta

SEQ ID NO: 424857 - DNA, 26 bp, Artificial Sequence
  Description of Artificial Sequence: Synthetic oligonucleotide
tgcggacgctgcgcggctactacaat

SEQ ID NO: 424858 - DNA, 25 bp, Artificial Sequence
  Description of Artificial Sequence: Synthetic oligonucleotide
gcggacgctgcgcggctactacaat

SEQ ID NO: 424859 - DNA, 26 bp, Artificial Sequence
  Description of Artificial Sequence: Synthetic oligonucleotide
cggacgctgcgcggctactacaatca

SEQ ID NO: 424860 - DNA, 27 bp, Artificial Sequence
  Description of Artificial Sequence: Synthetic oligonucleotide
ggacgctgcgcggctactacaatcaga

SEQ ID NO: 424861 - DNA, 27 bp, Artificial Sequence
  Description of Artificial Sequence: Synthetic oligonucleotide
gacgctgcgcggctactacaatcagag

SEQ ID NO: 424862 - DNA, 27 bp, Artificial Sequence
  Description of Artificial Sequence: Synthetic oligonucleotide
acgctgcgcggctactacaatcagagc

SEQ ID NO: 424863 - DNA, 26 bp, Artificial Sequence
  Description of Artificial Sequence: Synthetic oligonucleotide
cgctgcgcggctactacaatcagagc

SEQ ID NO: 424864 - DNA, 27 bp, Artificial Sequence
  Description of Artificial Sequence: Synthetic oligonucleotide
gctgcgcggctactacaatcagagcga

SEQ ID NO: 424865 - DNA, 26 bp, Artificial Sequence
  Description of Artificial Sequence: Synthetic oligonucleotide
gcgcggctactacaatcagagcgagg

SEQ ID NO: 424866 - DNA, 26 bp, Artificial Sequence
  Description of Artificial Sequence: Synthetic oligonucleotide
cgcggctactacaatcagagcgaggc

SEQ ID NO: 424867 - DNA, 26 bp, Artificial Sequence
  Description of Artificial Sequence: Synthetic oligonucleotide
gcggctactacaatcagagcgaggcc

SEQ ID NO: 424868 - DNA, 26 bp, Artificial Sequence
  Description of Artificial Sequence: Synthetic oligonucleotide
cggctactacaatcagagcgaggccg

SEQ ID NO: 424869 - DNA, 26 bp, Artificial Sequence
  Description of Artificial Sequence: Synthetic oligonucleotide
ggctactacaatcagagcgaggccgg

SEQ ID NO: 424870 - DNA, 27 bp, Artificial Sequence
  Description of Artificial Sequence: Synthetic oligonucleotide
gctactacaatcagagcgaggccgggt

SEQ ID NO: 424871 - DNA, 27 bp, Artificial Sequence
  Description of Artificial Sequence: Synthetic oligonucleotide
ctactacaatcagagcgaggccgggtc

SEQ ID NO: 424872 - DNA, 28 bp, Artificial Sequence
  Description of Artificial Sequence: Synthetic oligonucleotide
tactacaatcagagcgaggccgggtctc

SEQ ID NO: 424873 - DNA, 27 bp, Artificial Sequence
  Description of Artificial Sequence: Synthetic oligonucleotide
actacaatcagagcgaggccgggtctc

SEQ ID NO: 424874 - DNA, 27 bp, Artificial Sequence
  Description of Artificial Sequence: Synthetic oligonucleotide
ctacaatcagagcgaggccgggtctca

SEQ ID NO: 424875 - DNA, 27 bp, Artificial Sequence
  Description of Artificial Sequence: Synthetic oligonucleotide
tacaatcagagcgaggccgggtctcac

SEQ ID NO: 424876 - DNA, 27 bp, Artificial Sequence
  Description of Artificial Sequence: Synthetic oligonucleotide
acaatcagagcgaggccgggtctcaca

SEQ ID NO: 424877 - DNA, 26 bp, Artificial Sequence
  Description of Artificial Sequence: Synthetic oligonucleotide
caatcagagcgaggccgggtctcaca

SEQ ID NO: 424878 - DNA, 26 bp, Artificial Sequence
  Description of Artificial Sequence: Synthetic oligonucleotide
aatcagagcgaggccgggtctcacac

SEQ ID NO: 424879 - DNA, 25 bp, Artificial Sequence
  Description of Artificial Sequence: Synthetic oligonucleotide
atcagagcgaggccgggtctcacac

SEQ ID NO: 424880 - DNA, 24 bp, Artificial Sequence
  Description of Artificial Sequence: Synthetic oligonucleotide
tcagagcgaggccgggtctcacac

SEQ ID NO: 424881 - DNA, 22 bp, Artificial Sequence
  Description of Artificial Sequence: Synthetic oligonucleotide
cgaggccgggtctcacaccctg

SEQ ID NO: 424882 - DNA, 23 bp, Artificial Sequence
  Description of Artificial Sequence: Synthetic oligonucleotide
gaggccgggtctcacaccctgca

SEQ ID NO: 424883 - DNA, 24 bp, Artificial Sequence
  Description of Artificial Sequence: Synthetic oligonucleotide
aggccgggtctcacaccctgcagt

SEQ ID NO: 424884 - DNA, 23 bp, Artificial Sequence
  Description of Artificial Sequence: Synthetic oligonucleotide
ggccgggtctcacaccctgcagt

SEQ ID NO: 424885 - DNA, 23 bp, Artificial Sequence
  Description of Artificial Sequence: Synthetic oligonucleotide
gccgggtctcacaccctgcagtg

SEQ ID NO: 424886 - DNA, 25 bp, Artificial Sequence
  Description of Artificial Sequence: Synthetic oligonucleotide
ccgggtctcacaccctgcagtggat

SEQ ID NO: 424887 - DNA, 25 bp, Artificial Sequence
  Description of Artificial Sequence: Synthetic oligonucleotide
cgggtctcacaccctgcagtggatg

SEQ ID NO: 424888 - DNA, 27 bp, Artificial Sequence
  Description of Artificial Sequence: Synthetic oligonucleotide
gggtctcacaccctgcagtggatgcat

SEQ ID NO: 424889 - DNA, 27 bp, Artificial Sequence
  Description of Artificial Sequence: Synthetic oligonucleotide
ggtctcacaccctgcagtggatgcatg

SEQ ID NO: 424890 - DNA, 27 bp, Artificial Sequence
  Description of Artificial Sequence: Synthetic oligonucleotide
gtctcacaccctgcagtggatgcatgg

SEQ ID NO: 424891 - DNA, 27 bp, Artificial Sequence
  Description of Artificial Sequence: Synthetic oligonucleotide
tctcacaccctgcagtggatgcatggc

SEQ ID NO: 424892 - DNA, 27 bp, Artificial Sequence
  Description of Artificial Sequence: Synthetic oligonucleotide
ctcacaccctgcagtggatgcatggct

SEQ ID NO: 424893 - DNA, 27 bp, Artificial Sequence
  Description of Artificial Sequence: Synthetic oligonucleotide
tcacaccctgcagtggatgcatggctg

SEQ ID NO: 424894 - DNA, 26 bp, Artificial Sequence
  Description of Artificial Sequence: Synthetic oligonucleotide
cacaccctgcagtggatgcatggctg

SEQ ID NO: 424895 - DNA, 26 bp, Artificial Sequence
  Description of Artificial Sequence: Synthetic oligonucleotide
acaccctgcagtggatgcatggctgc

SEQ ID NO: 424896 - DNA, 25 bp, Artificial Sequence
  Description of Artificial Sequence: Synthetic oligonucleotide
caccctgcagtggatgcatggctgc

SEQ ID NO: 424897 - DNA, 26 bp, Artificial Sequence
  Description of Artificial Sequence: Synthetic oligonucleotide
accctgcagtggatgcatggctgcga

SEQ ID NO: 424898 - DNA, 25 bp, Artificial Sequence
  Description of Artificial Sequence: Synthetic oligonucleotide
ccctgcagtggatgcatggctgcga

SEQ ID NO: 424899 - DNA, 25 bp, Artificial Sequence
  Description of Artificial Sequence: Synthetic oligonucleotide
cctgcagtggatgcatggctgcgag

SEQ ID NO: 424900 - DNA, 26 bp, Artificial Sequence
  Description of Artificial Sequence: Synthetic oligonucleotide
ctgcagtggatgcatggctgcgagct

SEQ ID NO: 424901 - DNA, 26 bp, Artificial Sequence
  Description of Artificial Sequence: Synthetic oligonucleotide
tgcagtggatgcatggctgcgagctg

SEQ ID NO: 424902 - DNA, 25 bp, Artificial Sequence
  Description of Artificial Sequence: Synthetic oligonucleotide
gcagtggatgcatggctgcgagctg

SEQ ID NO: 424903 - DNA, 25 bp, Artificial Sequence
  Description of Artificial Sequence: Synthetic oligonucleotide
cagtggatgcatggctgcgagctgg

SEQ ID NO: 424904 - DNA, 25 bp, Artificial Sequence
  Description of Artificial Sequence: Synthetic oligonucleotide
agtggatgcatggctgcgagctggg

SEQ ID NO: 424905 - DNA, 24 bp, Artificial Sequence
  Description of Artificial Sequence: Synthetic oligonucleotide
gtggatgcatggctgcgagctggg

SEQ ID NO: 424906 - DNA, 24 bp, Artificial Sequence
  Description of Artificial Sequence: Synthetic oligonucleotide
tggatgcatggctgcgagctgggg

SEQ ID NO: 424907 - DNA, 23 bp, Artificial Sequence
  Description of Artificial Sequence: Synthetic oligonucleotide
ggatgcatggctgcgagctgggg

SEQ ID NO: 424908 - DNA, 23 bp, Artificial Sequence
  Description of Artificial Sequence: Synthetic oligonucleotide
gatgcatggctgcgagctggggc

SEQ ID NO: 424909 - DNA, 23 bp, Artificial Sequence
  Description of Artificial Sequence: Synthetic oligonucleotide
atgcatggctgcgagctggggcc

SEQ ID NO: 424910 - DNA, 22 bp, Artificial Sequence
  Description of Artificial Sequence: Synthetic oligonucleotide
tgcatggctgcgagctggggcc

SEQ ID NO: 424911 - DNA, 21 bp, Artificial Sequence
  Description of Artificial Sequence: Synthetic oligonucleotide
gcatggctgcgagctggggcc

SEQ ID NO: 424912 - DNA, 21 bp, Artificial Sequence
  Description of Artificial Sequence: Synthetic oligonucleotide
catggctgcgagctggggccc

SEQ ID NO: 424913 - DNA, 22 bp, Artificial Sequence
  Description of Artificial Sequence: Synthetic oligonucleotide
atggctgcgagctggggcccga

SEQ ID NO: 424914 - DNA, 21 bp, Artificial Sequence
  Description of Artificial Sequence: Synthetic oligonucleotide
tggctgcgagctggggcccga

SEQ ID NO: 424915 - DNA, 20 bp, Artificial Sequence
  Description of Artificial Sequence: Synthetic oligonucleotide
ggctgcgagctggggcccga

SEQ ID NO: 424916 - DNA, 21 bp, Artificial Sequence
  Description of Artificial Sequence: Synthetic oligonucleotide
gctgcgagctggggcccgaca

SEQ ID NO: 424917 - DNA, 21 bp, Artificial Sequence
  Description of Artificial Sequence: Synthetic oligonucleotide
ctgcgagctggggcccgacag

SEQ ID NO: 424918 - DNA, 21 bp, Artificial Sequence
  Description of Artificial Sequence: Synthetic oligonucleotide
tgcgagctggggcccgacagg

SEQ ID NO: 424919 - DNA, 20 bp, Artificial Sequence
  Description of Artificial Sequence: Synthetic oligonucleotide
gcgagctggggcccgacagg

SEQ ID NO: 424920 - DNA, 20 bp, Artificial Sequence
  Description of Artificial Sequence: Synthetic oligonucleotide
cgagctggggcccgacaggc

SEQ ID NO: 424921 - DNA, 20 bp, Artificial Sequence
  Description of Artificial Sequence: Synthetic oligonucleotide
gagctggggcccgacaggcg

SEQ ID NO: 424922 - DNA, 22 bp, Artificial Sequence
  Description of Artificial Sequence: Synthetic oligonucleotide
agctggggcccgacaggcgctt

SEQ ID NO: 424923 - DNA, 21 bp, Artificial Sequence
  Description of Artificial Sequence: Synthetic oligonucleotide
gctggggcccgacaggcgctt

SEQ ID NO: 424924 - DNA, 21 bp, Artificial Sequence
  Description of Artificial Sequence: Synthetic oligonucleotide
ctggggcccgacaggcgcttc

SEQ ID NO: 424925 - DNA, 22 bp, Artificial Sequence
  Description of Artificial Sequence: Synthetic oligonucleotide
tggggcccgacaggcgcttcct

SEQ ID NO: 424926 - DNA, 21 bp, Artificial Sequence
  Description of Artificial Sequence: Synthetic oligonucleotide
ggggcccgacaggcgcttcct

SEQ ID NO: 424927 - DNA, 21 bp, Artificial Sequence
  Description of Artificial Sequence: Synthetic oligonucleotide
gggcccgacaggcgcttcctc

SEQ ID NO: 424928 - DNA, 21 bp, Artificial Sequence
  Description of Artificial Sequence: Synthetic oligonucleotide
ggcccgacaggcgcttcctcc

SEQ ID NO: 424929 - DNA, 21 bp, Artificial Sequence
  Description of Artificial Sequence: Synthetic oligonucleotide
gcccgacaggcgcttcctccg

SEQ ID NO: 424930 - DNA, 21 bp, Artificial Sequence
  Description of Artificial Sequence: Synthetic oligonucleotide
cccgacaggcgcttcctccgc

SEQ ID NO: 424931 - DNA, 21 bp, Artificial Sequence
  Description of Artificial Sequence: Synthetic oligonucleotide
ccgacaggcgcttcctccgcg

SEQ ID NO: 424932 - DNA, 21 bp, Artificial Sequence
  Description of Artificial Sequence: Synthetic oligonucleotide
cgacaggcgcttcctccgcgg

SEQ ID NO: 424933 - DNA, 24 bp, Artificial Sequence
  Description of Artificial Sequence: Synthetic oligonucleotide
gacaggcgcttcctccgcgggtat

SEQ ID NO: 424934 - DNA, 26 bp, Artificial Sequence
  Description of Artificial Sequence: Synthetic oligonucleotide
acaggcgcttcctccgcgggtatgaa

SEQ ID NO: 424935 - DNA, 25 bp, Artificial Sequence
  Description of Artificial Sequence: Synthetic oligonucleotide
caggcgcttcctccgcgggtatgaa

SEQ ID NO: 424936 - DNA, 26 bp, Artificial Sequence
  Description of Artificial Sequence: Synthetic oligonucleotide
aggcgcttcctccgcgggtatgaaca

SEQ ID NO: 424937 - DNA, 27 bp, Artificial Sequence
  Description of Artificial Sequence: Synthetic oligonucleotide
gcgcttcctccgcgggtatgaacagtt

SEQ ID NO: 424938 - DNA, 27 bp, Artificial Sequence
  Description of Artificial Sequence: Synthetic oligonucleotide
cgcttcctccgcgggtatgaacagttc

SEQ ID NO: 424939 - DNA, 27 bp, Artificial Sequence
  Description of Artificial Sequence: Synthetic oligonucleotide
gcttcctccgcgggtatgaacagttcg

SEQ ID NO: 424940 - DNA, 27 bp, Artificial Sequence
  Description of Artificial Sequence: Synthetic oligonucleotide
cttcctccgcgggtatgaacagttcgc

SEQ ID NO: 424941 - DNA, 27 bp, Artificial Sequence
  Description of Artificial Sequence: Synthetic oligonucleotide
ttcctccgcgggtatgaacagttcgcc

SEQ ID NO: 424942 - DNA, 27 bp, Artificial Sequence
  Description of Artificial Sequence: Synthetic oligonucleotide
tcctccgcgggtatgaacagttcgcct

SEQ ID NO: 424943 - DNA, 27 bp, Artificial Sequence
  Description of Artificial Sequence: Synthetic oligonucleotide
cctccgcgggtatgaacagttcgccta

SEQ ID NO: 424944 - DNA, 27 bp, Artificial Sequence
  Description of Artificial Sequence: Synthetic oligonucleotide
ctccgcgggtatgaacagttcgcctac

SEQ ID NO: 424945 - DNA, 27 bp, Artificial Sequence
  Description of Artificial Sequence: Synthetic oligonucleotide
tccgcgggtatgaacagttcgcctacg

SEQ ID NO: 424946 - DNA, 27 bp, Artificial Sequence
  Description of Artificial Sequence: Synthetic oligonucleotide
ccgcgggtatgaacagttcgcctacga

SEQ ID NO: 424947 - DNA, 27 bp, Artificial Sequence
  Description of Artificial Sequence: Synthetic oligonucleotide
cgcgggtatgaacagttcgcctacgac

SEQ ID NO: 424948 - DNA, 27 bp, Artificial Sequence
  Description of Artificial Sequence: Synthetic oligonucleotide
gcgggtatgaacagttcgcctacgacg

SEQ ID NO: 424949 - DNA, 27 bp, Artificial Sequence
  Description of Artificial Sequence: Synthetic oligonucleotide
cgggtatgaacagttcgcctacgacgg

SEQ ID NO: 424950 - DNA, 27 bp, Artificial Sequence
  Description of Artificial Sequence: Synthetic oligonucleotide
gggtatgaacagttcgcctacgacggc

SEQ ID NO: 424951 - DNA, 29 bp, Artificial Sequence
  Description of Artificial Sequence: Synthetic oligonucleotide
ggtatgaacagttcgcctacgacggcaag

SEQ ID NO: 424952 - DNA, 29 bp, Artificial Sequence
  Description of Artificial Sequence: Synthetic oligonucleotide
gtatgaacagttcgcctacgacggcaagg

SEQ ID NO: 424953 - DNA, 34 bp, Artificial Sequence; identical to SEQ ID NO: 75863
  Description of Artificial Sequence: Synthetic oligonucleotide

SEQ ID NO: 424954 - DNA, 33 bp, Artificial Sequence; identical to SEQ ID NO: 75864
  Description of Artificial Sequence: Synthetic oligonucleotide

SEQ ID NO: 424955 - DNA, 32 bp, Artificial Sequence; identical to SEQ ID NO: 75865
  Description of Artificial Sequence: Synthetic oligonucleotide

SEQ ID NO: 424956 - DNA, 31 bp, Artificial Sequence; identical to SEQ ID NO: 75866
  Description of Artificial Sequence: Synthetic oligonucleotide

SEQ ID NO: 424957 - DNA, 32 bp, Artificial Sequence; identical to SEQ ID NO: 75867
  Description of Artificial Sequence: Synthetic oligonucleotide

SEQ ID NO: 424958 - DNA, 31 bp, Artificial Sequence; identical to SEQ ID NO: 75868
  Description of Artificial Sequence: Synthetic oligonucleotide

SEQ ID NO: 424959 - DNA, 30 bp, Artificial Sequence; identical to SEQ ID NO: 75869
  Description of Artificial Sequence: Synthetic oligonucleotide

SEQ ID NO: 424960 - DNA, 31 bp, Artificial Sequence; identical to SEQ ID NO: 75870
  Description of Artificial Sequence: Synthetic oligonucleotide

SEQ ID NO: 424961 - DNA, 30 bp, Artificial Sequence; identical to SEQ ID NO: 75871
  Description of Artificial Sequence: Synthetic oligonucleotide

SEQ ID NO: 424962 - DNA, 30 bp, Artificial Sequence; identical to SEQ ID NO: 75872
  Description of Artificial Sequence: Synthetic oligonucleotide

SEQ ID NO: 424963 - DNA, 29 bp, Artificial Sequence
  Description of Artificial Sequence: Synthetic oligonucleotide
tcgcctacgacggcaaggattatctcacc

SEQ ID NO: 424964 - DNA, 28 bp, Artificial Sequence
  Description of Artificial Sequence: Synthetic oligonucleotide
cgcctacgacggcaaggattatctcacc

SEQ ID NO: 424965 - DNA, 28 bp, Artificial Sequence
  Description of Artificial Sequence: Synthetic oligonucleotide
gcctacgacggcaaggattatctcaccc

SEQ ID NO: 424966 - DNA, 29 bp, Artificial Sequence
  Description of Artificial Sequence: Synthetic oligonucleotide
cctacgacggcaaggattatctcaccctg

SEQ ID NO: 424967 - DNA, 32 bp, Artificial Sequence; identical to SEQ ID NO: 75877
  Description of Artificial Sequence: Synthetic oligonucleotide

SEQ ID NO: 424968 - DNA, 33 bp, Artificial Sequence; identical to SEQ ID NO: 75878
  Description of Artificial Sequence: Synthetic oligonucleotide

SEQ ID NO: 424969 - DNA, 32 bp, Artificial Sequence; identical to SEQ ID NO: 75879
  Description of Artificial Sequence: Synthetic oligonucleotide

SEQ ID NO: 424970 - DNA, 31 bp, Artificial Sequence; identical to SEQ ID NO: 75880
  Description of Artificial Sequence: Synthetic oligonucleotide

SEQ ID NO: 424971 - DNA, 31 bp, Artificial Sequence; identical to SEQ ID NO: 75881
  Description of Artificial Sequence: Synthetic oligonucleotide

SEQ ID NO: 424972 - DNA, 32 bp, Artificial Sequence; identical to SEQ ID NO: 75882
  Description of Artificial Sequence: Synthetic oligonucleotide

SEQ ID NO: 424973 - DNA, 31 bp, Artificial Sequence; identical to SEQ ID NO: 75883
  Description of Artificial Sequence: Synthetic oligonucleotide

SEQ ID NO: 424974 - DNA, 31 bp, Artificial Sequence; identical to SEQ ID NO: 75884
  Description of Artificial Sequence: Synthetic oligonucleotide

SEQ ID NO: 424975 - DNA, 32 bp, Artificial Sequence; identical to SEQ ID NO: 75885
  Description of Artificial Sequence: Synthetic oligonucleotide

SEQ ID NO: 424976 - DNA, 32 bp, Artificial Sequence; identical to SEQ ID NO: 75886
  Description of Artificial Sequence: Synthetic oligonucleotide

SEQ ID NO: 424977 - DNA, 32 bp, Artificial Sequence; identical to SEQ ID NO: 75887
  Description of Artificial Sequence: Synthetic oligonucleotide

SEQ ID NO: 424978 - DNA, 31 bp, Artificial Sequence; identical to SEQ ID NO: 75888
  Description of Artificial Sequence: Synthetic oligonucleotide

SEQ ID NO: 424979 - DNA, 30 bp, Artificial Sequence; identical to SEQ ID NO: 75889
  Description of Artificial Sequence: Synthetic oligonucleotide

SEQ ID NO: 424980 - DNA, 30 bp, Artificial Sequence; identical to SEQ ID NO: 75890
  Description of Artificial Sequence: Synthetic oligonucleotide

SEQ ID NO: 424981 - DNA, 31 bp, Artificial Sequence; identical to SEQ ID NO: 75891
  Description of Artificial Sequence: Synthetic oligonucleotide

SEQ ID NO: 424982 - DNA, 30 bp, Artificial Sequence; identical to SEQ ID NO: 75892
  Description of Artificial Sequence: Synthetic oligonucleotide

SEQ ID NO: 424983 - DNA, 29 bp, Artificial Sequence
  Description of Artificial Sequence: Synthetic oligonucleotide
tatctcaccctgaatgaggacctgcgctc

SEQ ID NO: 424984 - DNA, 28 bp, Artificial Sequence
  Description of Artificial Sequence: Synthetic oligonucleotide
atctcaccctgaatgaggacctgcgctc

SEQ ID NO: 424985 - DNA, 27 bp, Artificial Sequence
  Description of Artificial Sequence: Synthetic oligonucleotide
tctcaccctgaatgaggacctgcgctc

SEQ ID NO: 424986 - DNA, 26 bp, Artificial Sequence
  Description of Artificial Sequence: Synthetic oligonucleotide
ctcaccctgaatgaggacctgcgctc

SEQ ID NO: 424987 - DNA, 27 bp, Artificial Sequence
  Description of Artificial Sequence: Synthetic oligonucleotide
tcaccctgaatgaggacctgcgctcct

SEQ ID NO: 424988 - DNA, 26 bp, Artificial Sequence
  Description of Artificial Sequence: Synthetic oligonucleotide
caccctgaatgaggacctgcgctcct

SEQ ID NO: 424989 - DNA, 26 bp, Artificial Sequence
  Description of Artificial Sequence: Synthetic oligonucleotide
accctgaatgaggacctgcgctcctg

SEQ ID NO: 424990 - DNA, 22 bp, Artificial Sequence
  Description of Artificial Sequence: Synthetic oligonucleotide
acctgcgctcctggaccgcggt

SEQ ID NO: 424991 - DNA, 21 bp, Artificial Sequence
  Description of Artificial Sequence: Synthetic oligonucleotide
cctgcgctcctggaccgcggt

SEQ ID NO: 424992 - DNA, 21 bp, Artificial Sequence
  Description of Artificial Sequence: Synthetic oligonucleotide
ctgcgctcctggaccgcggtg

SEQ ID NO: 424993 - DNA, 22 bp, Artificial Sequence
  Description of Artificial Sequence: Synthetic oligonucleotide
tgcgctcctggaccgcggtgga

SEQ ID NO: 424994 - DNA, 21 bp, Artificial Sequence
  Description of Artificial Sequence: Synthetic oligonucleotide
gcgctcctggaccgcggtgga

SEQ ID NO: 424995 - DNA, 22 bp, Artificial Sequence
  Description of Artificial Sequence: Synthetic oligonucleotide
cgctcctggaccgcggtggaca

SEQ ID NO: 424996 - DNA, 22 bp, Artificial Sequence
  Description of Artificial Sequence: Synthetic oligonucleotide
gctcctggaccgcggtggacac

SEQ ID NO: 424997 - DNA, 22 bp, Artificial Sequence
  Description of Artificial Sequence: Synthetic oligonucleotide
ctcctggaccgcggtggacacg

SEQ ID NO: 424998 - DNA, 22 bp, Artificial Sequence
  Description of Artificial Sequence: Synthetic oligonucleotide
tcctggaccgcggtggacacgg

SEQ ID NO: 424999 - DNA, 21 bp, Artificial Sequence
  Description of Artificial Sequence: Synthetic oligonucleotide
cctggaccgcggtggacacgg

SEQ ID NO: 425000 - DNA, 21 bp, Artificial Sequence
  Description of Artificial Sequence: Synthetic oligonucleotide
ctggaccgcggtggacacggc

SEQ ID NO: 425001 - DNA, 21 bp, Artificial Sequence
  Description of Artificial Sequence: Synthetic oligonucleotide
tggaccgcggtggacacggcg

SEQ ID NO: 425002 - DNA, 20 bp, Artificial Sequence
  Description of Artificial Sequence: Synthetic oligonucleotide
ggaccgcggtggacacggcg

SEQ ID NO: 425003 - DNA, 20 bp, Artificial Sequence
  Description of Artificial Sequence: Synthetic oligonucleotide
gaccgcggtggacacggcgg

SEQ ID NO: 425004 - DNA, 21 bp, Artificial Sequence
  Description of Artificial Sequence: Synthetic oligonucleotide
accgcggtggacacggcggct

SEQ ID NO: 425005 - DNA, 20 bp, Artificial Sequence
  Description of Artificial Sequence: Synthetic oligonucleotide
ccgcggtggacacggcggct

SEQ ID NO: 425006 - DNA, 21 bp, Artificial Sequence
  Description of Artificial Sequence: Synthetic oligonucleotide
cgcggtggacacggcggctca

SEQ ID NO: 425007 - DNA, 23 bp, Artificial Sequence
  Description of Artificial Sequence: Synthetic oligonucleotide
gcggtggacacggcggctcagat

SEQ ID NO: 425008 - DNA, 24 bp, Artificial Sequence
  Description of Artificial Sequence: Synthetic oligonucleotide
cggtggacacggcggctcagatct

SEQ ID NO: 425009 - DNA, 24 bp, Artificial Sequence
  Description of Artificial Sequence: Synthetic oligonucleotide
ggtggacacggcggctcagatctc

SEQ ID NO: 425010 - DNA, 24 bp, Artificial Sequence
  Description of Artificial Sequence: Synthetic oligonucleotide
gtggacacggcggctcagatctcc

SEQ ID NO: 425011 - DNA, 25 bp, Artificial Sequence
  Description of Artificial Sequence: Synthetic oligonucleotide
tggacacggcggctcagatctccga

SEQ ID NO: 425012 - DNA, 24 bp, Artificial Sequence
  Description of Artificial Sequence: Synthetic oligonucleotide
ggacacggcggctcagatctccga

SEQ ID NO: 425013 - DNA, 24 bp, Artificial Sequence
  Description of Artificial Sequence: Synthetic oligonucleotide
gacacggcggctcagatctccgag

SEQ ID NO: 425014 - DNA, 27 bp, Artificial Sequence
  Description of Artificial Sequence: Synthetic oligonucleotide
acacggcggctcagatctccgagcaaa

SEQ ID NO: 425015 - DNA, 27 bp, Artificial Sequence
  Description of Artificial Sequence: Synthetic oligonucleotide
cacggcggctcagatctccgagcaaaa

SEQ ID NO: 425016 - DNA, 27 bp, Artificial Sequence
  Description of Artificial Sequence: Synthetic oligonucleotide
acggcggctcagatctccgagcaaaag

SEQ ID NO: 425017 - DNA, 27 bp, Artificial Sequence
  Description of Artificial Sequence: Synthetic oligonucleotide
cggcggctcagatctccgagcaaaagt

SEQ ID NO: 425018 - DNA, 27 bp, Artificial Sequence
  Description of Artificial Sequence: Synthetic oligonucleotide
ggcggctcagatctccgagcaaaagtc

SEQ ID NO: 425019 - DNA, 31 bp, Artificial Sequence; identical to SEQ ID NO: 75928
  Description of Artificial Sequence: Synthetic oligonucleotide

SEQ ID NO: 425020 - DNA, 33 bp, Artificial Sequence; identical to SEQ ID NO: 75929
  Description of Artificial Sequence: Synthetic oligonucleotide

SEQ ID NO: 425021 - DNA, 33 bp, Artificial Sequence; identical to SEQ ID NO: 75930
  Description of Artificial Sequence: Synthetic oligonucleotide

SEQ ID NO: 425022 - DNA, 33 bp, Artificial Sequence; identical to SEQ ID NO: 75931
  Description of Artificial Sequence: Synthetic oligonucleotide

SEQ ID NO: 425023 - DNA, 34 bp, Artificial Sequence; identical to SEQ ID NO: 75932
  Description of Artificial Sequence: Synthetic oligonucleotide

SEQ ID NO: 425024 - DNA, 35 bp, Artificial Sequence; identical to SEQ ID NO: 75933
  Description of Artificial Sequence: Synthetic oligonucleotide

SEQ ID NO: 425025 - DNA, 34 bp, Artificial Sequence; identical to SEQ ID NO: 75934
  Description of Artificial Sequence: Synthetic oligonucleotide

SEQ ID NO: 425026 - DNA, 35 bp, Artificial Sequence; identical to SEQ ID NO: 75935
  Description of Artificial Sequence: Synthetic oligonucleotide

SEQ ID NO: 425027 - DNA, 34 bp, Artificial Sequence; identical to SEQ ID NO: 75936
  Description of Artificial Sequence: Synthetic oligonucleotide

SEQ ID NO: 425028 - DNA, 34 bp, Artificial Sequence; identical to SEQ ID NO: 75937
  Description of Artificial Sequence: Synthetic oligonucleotide

SEQ ID NO: 425029 - DNA, 33 bp, Artificial Sequence; identical to SEQ ID NO: 75938
  Description of Artificial Sequence: Synthetic oligonucleotide

SEQ ID NO: 425030 - DNA, 32 bp, Artificial Sequence; identical to SEQ ID NO: 75939
  Description of Artificial Sequence: Synthetic oligonucleotide

SEQ ID NO: 425031 - DNA, 32 bp, Artificial Sequence; identical to SEQ ID NO: 75940
  Description of Artificial Sequence: Synthetic oligonucleotide

SEQ ID NO: 425032 - DNA, 31 bp, Artificial Sequence; identical to SEQ ID NO: 75941
  Description of Artificial Sequence: Synthetic oligonucleotide

SEQ ID NO: 425033 - DNA, 31 bp, Artificial Sequence; identical to SEQ ID NO: 75942
  Description of Artificial Sequence: Synthetic oligonucleotide

SEQ ID NO: 425034 - DNA, 31 bp, Artificial Sequence; identical to SEQ ID NO: 75943
  Description of Artificial Sequence: Synthetic oligonucleotide

SEQ ID NO: 425035 - DNA, 32 bp, Artificial Sequence; identical to SEQ ID NO: 75944
  Description of Artificial Sequence: Synthetic oligonucleotide

SEQ ID NO: 425036 - DNA, 31 bp, Artificial Sequence; identical to SEQ ID NO: 75945
  Description of Artificial Sequence: Synthetic oligonucleotide

SEQ ID NO: 425037 - DNA, 31 bp, Artificial Sequence; identical to SEQ ID NO: 75946
  Description of Artificial Sequence: Synthetic oligonucleotide

SEQ ID NO: 425038 - DNA, 32 bp, Artificial Sequence; identical to SEQ ID NO: 75947
  Description of Artificial Sequence: Synthetic oligonucleotide

SEQ ID NO: 425039 - DNA, 31 bp, Artificial Sequence; identical to SEQ ID NO: 75948
  Description of Artificial Sequence: Synthetic oligonucleotide

SEQ ID NO: 425040 - DNA, 30 bp, Artificial Sequence; identical to SEQ ID NO: 75949
  Description of Artificial Sequence: Synthetic oligonucleotide

SEQ ID NO: 425041 - DNA, 29 bp, Artificial Sequence
  Description of Artificial Sequence: Synthetic oligonucleotide
agtcaaatgatgcctctgaggcggagcac

SEQ ID NO: 425042 - DNA, 28 bp, Artificial Sequence
  Description of Artificial Sequence: Synthetic oligonucleotide
gtcaaatgatgcctctgaggcggagcac

SEQ ID NO: 425043 - DNA, 28 bp, Artificial Sequence
  Description of Artificial Sequence: Synthetic oligonucleotide
tcaaatgatgcctctgaggcggagcacc

SEQ ID NO: 425044 - DNA, 27 bp, Artificial Sequence
  Description of Artificial Sequence: Synthetic oligonucleotide
caaatgatgcctctgaggcggagcacc

SEQ ID NO: 425045 - DNA, 28 bp, Artificial Sequence
  Description of Artificial Sequence: Synthetic oligonucleotide
aaatgatgcctctgaggcggagcaccag

SEQ ID NO: 425046 - DNA, 27 bp, Artificial Sequence
  Description of Artificial Sequence: Synthetic oligonucleotide
aatgatgcctctgaggcggagcaccag

SEQ ID NO: 425047 - DNA, 27 bp, Artificial Sequence
  Description of Artificial Sequence: Synthetic oligonucleotide
atgatgcctctgaggcggagcaccaga

SEQ ID NO: 425048 - DNA, 26 bp, Artificial Sequence
  Description of Artificial Sequence: Synthetic oligonucleotide
tgatgcctctgaggcggagcaccaga

SEQ ID NO: 425049 - DNA, 25 bp, Artificial Sequence
  Description of Artificial Sequence: Synthetic oligonucleotide
gatgcctctgaggcggagcaccaga

SEQ ID NO: 425050 - DNA, 26 bp, Artificial Sequence
  Description of Artificial Sequence: Synthetic oligonucleotide
atgcctctgaggcggagcaccagaga

SEQ ID NO: 425051 - DNA, 25 bp, Artificial Sequence
  Description of Artificial Sequence: Synthetic oligonucleotide
tgcctctgaggcggagcaccagaga

SEQ ID NO: 425052 - DNA, 24 bp, Artificial Sequence
  Description of Artificial Sequence: Synthetic oligonucleotide
gcctctgaggcggagcaccagaga

SEQ ID NO: 425053 - DNA, 24 bp, Artificial Sequence
  Description of Artificial Sequence: Synthetic oligonucleotide
cctctgaggcggagcaccagagag

SEQ ID NO: 425054 - DNA, 24 bp, Artificial Sequence
  Description of Artificial Sequence: Synthetic oligonucleotide
ctctgaggcggagcaccagagagc

SEQ ID NO: 425055 - DNA, 26 bp, Artificial Sequence
  Description of Artificial Sequence: Synthetic oligonucleotide
tctgaggcggagcaccagagagccta

SEQ ID NO: 425056 - DNA, 25 bp, Artificial Sequence
  Description of Artificial Sequence: Synthetic oligonucleotide
ctgaggcggagcaccagagagccta

SEQ ID NO: 425057 - DNA, 25 bp, Artificial Sequence
  Description of Artificial Sequence: Synthetic oligonucleotide
tgaggcggagcaccagagagcctac

SEQ ID NO: 425058 - DNA, 24 bp, Artificial Sequence
  Description of Artificial Sequence: Synthetic oligonucleotide
gaggcggagcaccagagagcctac

SEQ ID NO: 425059 - DNA, 25 bp, Artificial Sequence
  Description of Artificial Sequence: Synthetic oligonucleotide
aggcggagcaccagagagcctacct

SEQ ID NO: 425060 - DNA, 24 bp, Artificial Sequence
  Description of Artificial Sequence: Synthetic oligonucleotide
ggcggagcaccagagagcctacct

SEQ ID NO: 425061 - DNA, 24 bp, Artificial Sequence
  Description of Artificial Sequence: Synthetic oligonucleotide
gcggagcaccagagagcctacctg

SEQ ID NO: 425062 - DNA, 26 bp, Artificial Sequence
  Description of Artificial Sequence: Synthetic oligonucleotide
cggagcaccagagagcctacctggaa

SEQ ID NO: 425063 - DNA, 27 bp, Artificial Sequence
  Description of Artificial Sequence: Synthetic oligonucleotide
ggagcaccagagagcctacctggaaga

SEQ ID NO: 425064 - DNA, 27 bp, Artificial Sequence
  Description of Artificial Sequence: Synthetic oligonucleotide
gagcaccagagagcctacctggaagac

SEQ ID NO: 425065 - DNA, 28 bp, Artificial Sequence
  Description of Artificial Sequence: Synthetic oligonucleotide
agcaccagagagcctacctggaagacac

SEQ ID NO: 425066 - DNA, 27 bp, Artificial Sequence
  Description of Artificial Sequence: Synthetic oligonucleotide
gcaccagagagcctacctggaagacac

SEQ ID NO: 425067 - DNA, 29 bp, Artificial Sequence
  Description of Artificial Sequence: Synthetic oligonucleotide
caccagagagcctacctggaagacacatg

SEQ ID NO: 425068 - DNA, 29 bp, Artificial Sequence
  Description of Artificial Sequence: Synthetic oligonucleotide
accagagagcctacctggaagacacatgc

SEQ ID NO: 425069 - DNA, 28 bp, Artificial Sequence
  Description of Artificial Sequence: Synthetic oligonucleotide
ccagagagcctacctggaagacacatgc

SEQ ID NO: 425070 - DNA, 28 bp, Artificial Sequence
  Description of Artificial Sequence: Synthetic oligonucleotide
cagagagcctacctggaagacacatgcg

SEQ ID NO: 425071 - DNA, 29 bp, Artificial Sequence
  Description of Artificial Sequence: Synthetic oligonucleotide
agagagcctacctggaagacacatgcgtg

SEQ ID NO: 425072 - DNA, 28 bp, Artificial Sequence
  Description of Artificial Sequence: Synthetic oligonucleotide
gagagcctacctggaagacacatgcgtg

SEQ ID NO: 425073 - DNA, 28 bp, Artificial Sequence
  Description of Artificial Sequence: Synthetic oligonucleotide
agagcctacctggaagacacatgcgtgg

SEQ ID NO: 425074 - DNA, 27 bp, Artificial Sequence
  Description of Artificial Sequence: Synthetic oligonucleotide
gagcctacctggaagacacatgcgtgg

SEQ ID NO: 425075 - DNA, 28 bp, Artificial Sequence
  Description of Artificial Sequence: Synthetic oligonucleotide
agcctacctggaagacacatgcgtggag

SEQ ID NO: 425076 - DNA, 27 bp, Artificial Sequence
  Description of Artificial Sequence: Synthetic oligonucleotide
gcctacctggaagacacatgcgtggag

SEQ ID NO: 425077 - DNA, 28 bp, Artificial Sequence
  Description of Artificial Sequence: Synthetic oligonucleotide
cctacctggaagacacatgcgtggagtg

SEQ ID NO: 425078 - DNA, 28 bp, Artificial Sequence
  Description of Artificial Sequence: Synthetic oligonucleotide
ctacctggaagacacatgcgtggagtgg

SEQ ID NO: 425079 - DNA, 28 bp, Artificial Sequence
  Description of Artificial Sequence: Synthetic oligonucleotide
tacctggaagacacatgcgtggagtggc

SEQ ID NO: 425080 - DNA, 27 bp, Artificial Sequence
  Description of Artificial Sequence: Synthetic oligonucleotide
acctggaagacacatgcgtggagtggc

SEQ ID NO: 425081 - DNA, 27 bp, Artificial Sequence
  Description of Artificial Sequence: Synthetic oligonucleotide
cctggaagacacatgcgtggagtggct

SEQ ID NO: 425082 - DNA, 27 bp, Artificial Sequence
  Description of Artificial Sequence: Synthetic oligonucleotide
ctggaagacacatgcgtggagtggctc

SEQ ID NO: 425083 - DNA, 27 bp, Artificial Sequence
  Description of Artificial Sequence: Synthetic oligonucleotide
tggaagacacatgcgtggagtggctcc

SEQ ID NO: 425084 - DNA, 27 bp, Artificial Sequence
  Description of Artificial Sequence: Synthetic oligonucleotide
ggaagacacatgcgtggagtggctcca

SEQ ID NO: 425085 - DNA, 27 bp, Artificial Sequence
  Description of Artificial Sequence: Synthetic oligonucleotide
gaagacacatgcgtggagtggctccac

SEQ ID NO: 425086 - DNA, 32 bp, Artificial Sequence; identical to SEQ ID NO: 75995
  Description of Artificial Sequence: Synthetic oligonucleotide

SEQ ID NO: 425087 - DNA, 31 bp, Artificial Sequence; identical to SEQ ID NO: 75996
  Description of Artificial Sequence: Synthetic oligonucleotide

SEQ ID NO: 425088 - DNA, 30 bp, Artificial Sequence; identical to SEQ ID NO: 75997
  Description of Artificial Sequence: Synthetic oligonucleotide

SEQ ID NO: 425089 - DNA, 30 bp, Artificial Sequence; identical to SEQ ID NO: 75998
  Description of Artificial Sequence: Synthetic oligonucleotide

SEQ ID NO: 425090 - DNA, 29 bp, Artificial Sequence
  Description of Artificial Sequence: Synthetic oligonucleotide
cacatgcgtggagtggctccacaaatacc

SEQ ID NO: 425091 - DNA, 30 bp, Artificial Sequence; identical to SEQ ID NO: 76000
  Description of Artificial Sequence: Synthetic oligonucleotide

SEQ ID NO: 425092 - DNA, 29 bp, Artificial Sequence
  Description of Artificial Sequence: Synthetic oligonucleotide
catgcgtggagtggctccacaaatacctg

SEQ ID NO: 425093 - DNA, 29 bp, Artificial Sequence
  Description of Artificial Sequence: Synthetic oligonucleotide
atgcgtggagtggctccacaaatacctgg

SEQ ID NO: 425094 - DNA, 28 bp, Artificial Sequence
  Description of Artificial Sequence: Synthetic oligonucleotide
tgcgtggagtggctccacaaatacctgg

SEQ ID NO: 425095 - DNA, 27 bp, Artificial Sequence
  Description of Artificial Sequence: Synthetic oligonucleotide
gcgtggagtggctccacaaatacctgg

SEQ ID NO: 425096 - DNA, 28 bp, Artificial Sequence
  Description of Artificial Sequence: Synthetic oligonucleotide
cgtggagtggctccacaaatacctggag

SEQ ID NO: 425097 - DNA, 30 bp, Artificial Sequence; identical to SEQ ID NO: 76006
  Description of Artificial Sequence: Synthetic oligonucleotide

SEQ ID NO: 425098 - DNA, 30 bp, Artificial Sequence; identical to SEQ ID NO: 76007
  Description of Artificial Sequence: Synthetic oligonucleotide

SEQ ID NO: 425099 - DNA, 29 bp, Artificial Sequence
  Description of Artificial Sequence: Synthetic oligonucleotide
ggagtggctccacaaatacctggagaagg

SEQ ID NO: 425100 - DNA, 29 bp, Artificial Sequence
  Description of Artificial Sequence: Synthetic oligonucleotide
gagtggctccacaaatacctggagaaggg

SEQ ID NO: 425101 - DNA, 29 bp, Artificial Sequence
  Description of Artificial Sequence: Synthetic oligonucleotide
agtggctccacaaatacctggagaagggg

SEQ ID NO: 425102 - DNA, 28 bp, Artificial Sequence
  Description of Artificial Sequence: Synthetic oligonucleotide
gtggctccacaaatacctggagaagggg

SEQ ID NO: 425103 - DNA, 30 bp, Artificial Sequence; identical to SEQ ID NO: 76012
  Description of Artificial Sequence: Synthetic oligonucleotide

SEQ ID NO: 425104 - DNA, 29 bp, Artificial Sequence
  Description of Artificial Sequence: Synthetic oligonucleotide
ggctccacaaatacctggagaaggggaag

SEQ ID NO: 425105 - DNA, 29 bp, Artificial Sequence
  Description of Artificial Sequence: Synthetic oligonucleotide
gctccacaaatacctggagaaggggaagg

SEQ ID NO: 425106 - DNA, 30 bp, Artificial Sequence; identical to SEQ ID NO: 76015
  Description of Artificial Sequence: Synthetic oligonucleotide

SEQ ID NO: 425107 - DNA, 31 bp, Artificial Sequence; identical to SEQ ID NO: 76016
  Description of Artificial Sequence: Synthetic oligonucleotide

SEQ ID NO: 425108 - DNA, 30 bp, Artificial Sequence; identical to SEQ ID NO: 76017
  Description of Artificial Sequence: Synthetic oligonucleotide

SEQ ID NO: 425109 - DNA, 30 bp, Artificial Sequence; identical to SEQ ID NO: 76018
  Description of Artificial Sequence: Synthetic oligonucleotide

SEQ ID NO: 425110 - DNA, 30 bp, Artificial Sequence; identical to SEQ ID NO: 76019
  Description of Artificial Sequence: Synthetic oligonucleotide

SEQ ID NO: 425111 - DNA, 29 bp, Artificial Sequence
  Description of Artificial Sequence: Synthetic oligonucleotide
caaatacctggagaaggggaaggagacgc

SEQ ID NO: 425112 - DNA, 30 bp, Artificial Sequence; identical to SEQ ID NO: 76021
  Description of Artificial Sequence: Synthetic oligonucleotide

SEQ ID NO: 425113 - DNA, 29 bp, Artificial Sequence
  Description of Artificial Sequence: Synthetic oligonucleotide
aatacctggagaaggggaaggagacgctg

SEQ ID NO: 425114 - DNA, 28 bp, Artificial Sequence
  Description of Artificial Sequence: Synthetic oligonucleotide
atacctggagaaggggaaggagacgctg

SEQ ID NO: 425115 - DNA, 27 bp, Artificial Sequence
  Description of Artificial Sequence: Synthetic oligonucleotide
tacctggagaaggggaaggagacgctg

SEQ ID NO: 425116 - DNA, 26 bp, Artificial Sequence
  Description of Artificial Sequence: Synthetic oligonucleotide
acctggagaaggggaaggagacgctg

SEQ ID NO: 425117 - DNA, 25 bp, Artificial Sequence
  Description of Artificial Sequence: Synthetic oligonucleotide
cctggagaaggggaaggagacgctg

SEQ ID NO: 425118 - DNA, 27 bp, Artificial Sequence
  Description of Artificial Sequence: Synthetic oligonucleotide
ctggagaaggggaaggagacgctgctt

SEQ ID NO: 425119 - DNA, 27 bp, Artificial Sequence
  Description of Artificial Sequence: Synthetic oligonucleotide
tggagaaggggaaggagacgctgcttc

SEQ ID NO: 425120 - DNA, 27 bp, Artificial Sequence
  Description of Artificial Sequence: Synthetic oligonucleotide
ggagaaggggaaggagacgctgcttca

SEQ ID NO: 425121 - DNA, 27 bp, Artificial Sequence
  Description of Artificial Sequence: Synthetic oligonucleotide
gagaaggggaaggagacgctgcttcac

SEQ ID NO: 425122 - DNA, 27 bp, Artificial Sequence
  Description of Artificial Sequence: Synthetic oligonucleotide
agaaggggaaggagacgctgcttcacc

SEQ ID NO: 425123 - DNA, 27 bp, Artificial Sequence
  Description of Artificial Sequence: Synthetic oligonucleotide
gaaggggaaggagacgctgcttcacct

SEQ ID NO: 425124 - DNA, 27 bp, Artificial Sequence
  Description of Artificial Sequence: Synthetic oligonucleotide
aaggggaaggagacgctgcttcacctg

SEQ ID NO: 425125 - DNA, 26 bp, Artificial Sequence
  Description of Artificial Sequence: Synthetic oligonucleotide
aggggaaggagacgctgcttcacctg

SEQ ID NO: 425126 - DNA, 25 bp, Artificial Sequence
  Description of Artificial Sequence: Synthetic oligonucleotide
ggggaaggagacgctgcttcacctg

SEQ ID NO: 425127 - DNA, 26 bp, Artificial Sequence
  Description of Artificial Sequence: Synthetic oligonucleotide
gggaaggagacgctgcttcacctgga

SEQ ID NO: 425128 - DNA, 26 bp, Artificial Sequence
  Description of Artificial Sequence: Synthetic oligonucleotide
ggaaggagacgctgcttcacctggag

SEQ ID NO: 425129 - DNA, 26 bp, Artificial Sequence
  Description of Artificial Sequence: Synthetic oligonucleotide
gaaggagacgctgcttcacctggagc

SEQ ID NO: 425130 - DNA, 26 bp, Artificial Sequence
  Description of Artificial Sequence: Synthetic oligonucleotide
aaggagacgctgcttcacctggagcc

SEQ ID NO: 425131 - DNA, 25 bp, Artificial Sequence
  Description of Artificial Sequence: Synthetic oligonucleotide
aggagacgctgcttcacctggagcc

SEQ ID NO: 425132 - DNA, 24 bp, Artificial Sequence
  Description of Artificial Sequence: Synthetic oligonucleotide
ggagacgctgcttcacctggagcc

SEQ ID NO: 425133 - DNA, 24 bp, Artificial Sequence
  Description of Artificial Sequence: Synthetic oligonucleotide
gagacgctgcttcacctggagccc

SEQ ID NO: 425134 - DNA, 24 bp, Artificial Sequence
  Description of Artificial Sequence: Synthetic oligonucleotide
agacgctgcttcacctggagcccc

SEQ ID NO: 425135 - DNA, 23 bp, Artificial Sequence
  Description of Artificial Sequence: Synthetic oligonucleotide
gacgctgcttcacctggagcccc

SEQ ID NO: 425136 - DNA, 26 bp, Artificial Sequence
  Description of Artificial Sequence: Synthetic oligonucleotide
acgctgcttcacctggagcccccaaa

SEQ ID NO: 425137 - DNA, 25 bp, Artificial Sequence
  Description of Artificial Sequence: Synthetic oligonucleotide
cgctgcttcacctggagcccccaaa

SEQ ID NO: 425138 - DNA, 26 bp, Artificial Sequence
  Description of Artificial Sequence: Synthetic oligonucleotide
gctgcttcacctggagcccccaaaga

SEQ ID NO: 425139 - DNA, 27 bp, Artificial Sequence
  Description of Artificial Sequence: Synthetic oligonucleotide
ctgcttcacctggagcccccaaagaca

SEQ ID NO: 425140 - DNA, 27 bp, Artificial Sequence
  Description of Artificial Sequence: Synthetic oligonucleotide
tgcttcacctggagcccccaaagacac

SEQ ID NO: 425141 - DNA, 27 bp, Artificial Sequence
  Description of Artificial Sequence: Synthetic oligonucleotide
gcttcacctggagcccccaaagacaca

SEQ ID NO: 425142 - DNA, 27 bp, Artificial Sequence
  Description of Artificial Sequence: Synthetic oligonucleotide
cttcacctggagcccccaaagacacac

SEQ ID NO: 425143 - DNA, 27 bp, Artificial Sequence
  Description of Artificial Sequence: Synthetic oligonucleotide
ttcacctggagcccccaaagacacacg

SEQ ID NO: 425144 - DNA, 27 bp, Artificial Sequence
  Description of Artificial Sequence: Synthetic oligonucleotide
tcacctggagcccccaaagacacacgt

SEQ ID NO: 425145 - DNA, 26 bp, Artificial Sequence
  Description of Artificial Sequence: Synthetic oligonucleotide
cacctggagcccccaaagacacacgt

SEQ ID NO: 425146 - DNA, 27 bp, Artificial Sequence
  Description of Artificial Sequence: Synthetic oligonucleotide
acctggagcccccaaagacacacgtga

SEQ ID NO: 425147 - DNA, 26 bp, Artificial Sequence
  Description of Artificial Sequence: Synthetic oligonucleotide
cctggagcccccaaagacacacgtga

SEQ ID NO: 425148 - DNA, 27 bp, Artificial Sequence
  Description of Artificial Sequence: Synthetic oligonucleotide
ctggagcccccaaagacacacgtgact

SEQ ID NO: 425149 - DNA, 27 bp, Artificial Sequence
  Description of Artificial Sequence: Synthetic oligonucleotide
tggagcccccaaagacacacgtgactc

SEQ ID NO: 425150 - DNA, 27 bp, Artificial Sequence
  Description of Artificial Sequence: Synthetic oligonucleotide
ggagcccccaaagacacacgtgactca

SEQ ID NO: 425151 - DNA, 27 bp, Artificial Sequence
  Description of Artificial Sequence: Synthetic oligonucleotide
gagcccccaaagacacacgtgactcac

SEQ ID NO: 425152 - DNA, 27 bp, Artificial Sequence
  Description of Artificial Sequence: Synthetic oligonucleotide
agcccccaaagacacacgtgactcacc

SEQ ID NO: 425153 - DNA, 27 bp, Artificial Sequence
  Description of Artificial Sequence: Synthetic oligonucleotide
gcccccaaagacacacgtgactcacca

SEQ ID NO: 425154 - DNA, 27 bp, Artificial Sequence
  Description of Artificial Sequence: Synthetic oligonucleotide
cccccaaagacacacgtgactcaccac

SEQ ID NO: 425155 - DNA, 27 bp, Artificial Sequence
  Description of Artificial Sequence: Synthetic oligonucleotide
ccccaaagacacacgtgactcaccacc

SEQ ID NO: 425156 - DNA, 27 bp, Artificial Sequence
  Description of Artificial Sequence: Synthetic oligonucleotide
cccaaagacacacgtgactcaccaccc

SEQ ID NO: 425157 - DNA, 27 bp, Artificial Sequence
  Description of Artificial Sequence: Synthetic oligonucleotide
ccaaagacacacgtgactcaccacccc

SEQ ID NO: 425158 - DNA, 29 bp, Artificial Sequence
  Description of Artificial Sequence: Synthetic oligonucleotide
caaagacacacgtgactcaccaccccatc

SEQ ID NO: 425159 - DNA, 30 bp, Artificial Sequence; identical to SEQ ID NO: 76068
  Description of Artificial Sequence: Synthetic oligonucleotide

SEQ ID NO: 425160 - DNA, 29 bp, Artificial Sequence
  Description of Artificial Sequence: Synthetic oligonucleotide
aagacacacgtgactcaccaccccatctc

SEQ ID NO: 425161 - DNA, 28 bp, Artificial Sequence
  Description of Artificial Sequence: Synthetic oligonucleotide
agacacacgtgactcaccaccccatctc

SEQ ID NO: 425162 - DNA, 27 bp, Artificial Sequence
  Description of Artificial Sequence: Synthetic oligonucleotide
gacacacgtgactcaccaccccatctc

SEQ ID NO: 425163 - DNA, 28 bp, Artificial Sequence
  Description of Artificial Sequence: Synthetic oligonucleotide
acacacgtgactcaccaccccatctctg

SEQ ID NO: 425164 - DNA, 27 bp, Artificial Sequence
  Description of Artificial Sequence: Synthetic oligonucleotide
cacacgtgactcaccaccccatctctg

SEQ ID NO: 425165 - DNA, 28 bp, Artificial Sequence
  Description of Artificial Sequence: Synthetic oligonucleotide
acacgtgactcaccaccccatctctgac

SEQ ID NO: 425166 - DNA, 27 bp, Artificial Sequence
  Description of Artificial Sequence: Synthetic oligonucleotide
cacgtgactcaccaccccatctctgac

SEQ ID NO: 425167 - DNA, 27 bp, Artificial Sequence
  Description of Artificial Sequence: Synthetic oligonucleotide
acgtgactcaccaccccatctctgacc

SEQ ID NO: 425168 - DNA, 27 bp, Artificial Sequence
  Description of Artificial Sequence: Synthetic oligonucleotide
cgtgactcaccaccccatctctgacca

SEQ ID NO: 425169 - DNA, 28 bp, Artificial Sequence
  Description of Artificial Sequence: Synthetic oligonucleotide
gtgactcaccaccccatctctgaccatg

SEQ ID NO: 425170 - DNA, 29 bp, Artificial Sequence
  Description of Artificial Sequence: Synthetic oligonucleotide
tgactcaccaccccatctctgaccatgag

SEQ ID NO: 425171 - DNA, 28 bp, Artificial Sequence
  Description of Artificial Sequence: Synthetic oligonucleotide
gactcaccaccccatctctgaccatgag

SEQ ID NO: 425172 - DNA, 28 bp, Artificial Sequence
  Description of Artificial Sequence: Synthetic oligonucleotide
actcaccaccccatctctgaccatgagg

SEQ ID NO: 425173 - DNA, 27 bp, Artificial Sequence
  Description of Artificial Sequence: Synthetic oligonucleotide
ctcaccaccccatctctgaccatgagg

SEQ ID NO: 425174 - DNA, 27 bp, Artificial Sequence
  Description of Artificial Sequence: Synthetic oligonucleotide
tcaccaccccatctctgaccatgaggc

SEQ ID NO: 425175 - DNA, 27 bp, Artificial Sequence
  Description of Artificial Sequence: Synthetic oligonucleotide
tgcggagatcacactgacctggcagca

SEQ ID NO: 425176 - DNA, 26 bp, Artificial Sequence
  Description of Artificial Sequence: Synthetic oligonucleotide
gcggagatcacactgacctggcagca

SEQ ID NO: 425177 - DNA, 26 bp, Artificial Sequence
  Description of Artificial Sequence: Synthetic oligonucleotide
cggagatcacactgacctggcagcag

SEQ ID NO: 425178 - DNA, 27 bp, Artificial Sequence
  Description of Artificial Sequence: Synthetic oligonucleotide
ggagatcacactgacctggcagcagga

SEQ ID NO: 425179 - DNA, 28 bp, Artificial Sequence
  Description of Artificial Sequence: Synthetic oligonucleotide
gagatcacactgacctggcagcaggatg

SEQ ID NO: 425180 - DNA, 28 bp, Artificial Sequence
  Description of Artificial Sequence: Synthetic oligonucleotide
agatcacactgacctggcagcaggatgg

SEQ ID NO: 425181 - DNA, 27 bp, Artificial Sequence
  Description of Artificial Sequence: Synthetic oligonucleotide
gatcacactgacctggcagcaggatgg

SEQ ID NO: 425182 - DNA, 27 bp, Artificial Sequence
  Description of Artificial Sequence: Synthetic oligonucleotide
atcacactgacctggcagcaggatggg

SEQ ID NO: 425183 - DNA, 26 bp, Artificial Sequence
  Description of Artificial Sequence: Synthetic oligonucleotide
tcacactgacctggcagcaggatggg

SEQ ID NO: 425184 - DNA, 25 bp, Artificial Sequence
  Description of Artificial Sequence: Synthetic oligonucleotide
cacactgacctggcagcaggatggg

SEQ ID NO: 425185 - DNA, 26 bp, Artificial Sequence
  Description of Artificial Sequence: Synthetic oligonucleotide
acactgacctggcagcaggatgggga

SEQ ID NO: 425186 - DNA, 25 bp, Artificial Sequence
  Description of Artificial Sequence: Synthetic oligonucleotide
cactgacctggcagcaggatgggga

SEQ ID NO: 425187 - DNA, 25 bp, Artificial Sequence
  Description of Artificial Sequence: Synthetic oligonucleotide
actgacctggcagcaggatggggag

SEQ ID NO: 425188 - DNA, 24 bp, Artificial Sequence
  Description of Artificial Sequence: Synthetic oligonucleotide
ctgacctggcagcaggatggggag

SEQ ID NO: 425189 - DNA, 24 bp, Artificial Sequence
  Description of Artificial Sequence: Synthetic oligonucleotide
tgacctggcagcaggatggggagg

SEQ ID NO: 425190 - DNA, 23 bp, Artificial Sequence
  Description of Artificial Sequence: Synthetic oligonucleotide
gacctggcagcaggatggggagg

SEQ ID NO: 425191 - DNA, 23 bp, Artificial Sequence
  Description of Artificial Sequence: Synthetic oligonucleotide
acctggcagcaggatggggaggg

SEQ ID NO: 425192 - DNA, 22 bp, Artificial Sequence
  Description of Artificial Sequence: Synthetic oligonucleotide
cctggcagcaggatggggaggg

SEQ ID NO: 425193 - DNA, 22 bp, Artificial Sequence
  Description of Artificial Sequence: Synthetic oligonucleotide
ctggcagcaggatggggagggc

SEQ ID NO: 425194 - DNA, 25 bp, Artificial Sequence
  Description of Artificial Sequence: Synthetic oligonucleotide
tggcagcaggatggggagggccata

SEQ ID NO: 425195 - DNA, 24 bp, Artificial Sequence
  Description of Artificial Sequence: Synthetic oligonucleotide
ggcagcaggatggggagggccata

SEQ ID NO: 425196 - DNA, 24 bp, Artificial Sequence
  Description of Artificial Sequence: Synthetic oligonucleotide
gcagcaggatggggagggccatac

SEQ ID NO: 425197 - DNA, 24 bp, Artificial Sequence
  Description of Artificial Sequence: Synthetic oligonucleotide
cagcaggatggggagggccatacc

SEQ ID NO: 425198 - DNA, 25 bp, Artificial Sequence
  Description of Artificial Sequence: Synthetic oligonucleotide
agcaggatggggagggccataccca

SEQ ID NO: 425199 - DNA, 24 bp, Artificial Sequence
  Description of Artificial Sequence: Synthetic oligonucleotide
gcaggatggggagggccataccca

SEQ ID NO: 425200 - DNA, 24 bp, Artificial Sequence
  Description of Artificial Sequence: Synthetic oligonucleotide
caggatggggagggccatacccag

SEQ ID NO: 425201 - DNA, 25 bp, Artificial Sequence
  Description of Artificial Sequence: Synthetic oligonucleotide
aggatggggagggccatacccagga

SEQ ID NO: 425202 - DNA, 24 bp, Artificial Sequence
  Description of Artificial Sequence: Synthetic oligonucleotide
ggatggggagggccatacccagga

SEQ ID NO: 425203 - DNA, 25 bp, Artificial Sequence
  Description of Artificial Sequence: Synthetic oligonucleotide
gatggggagggccatacccaggaca

SEQ ID NO: 425204 - DNA, 25 bp, Artificial Sequence
  Description of Artificial Sequence: Synthetic oligonucleotide
atggggagggccatacccaggacac

SEQ ID NO: 425205 - DNA, 24 bp, Artificial Sequence
  Description of Artificial Sequence: Synthetic oligonucleotide
tggggagggccatacccaggacac

SEQ ID NO: 425206 - DNA, 23 bp, Artificial Sequence
  Description of Artificial Sequence: Synthetic oligonucleotide
ggggagggccatacccaggacac

SEQ ID NO: 425207 - DNA, 23 bp, Artificial Sequence
  Description of Artificial Sequence: Synthetic oligonucleotide
gggagggccatacccaggacacg

SEQ ID NO: 425208 - DNA, 24 bp, Artificial Sequence
  Description of Artificial Sequence: Synthetic oligonucleotide
ggagggccatacccaggacacgga

SEQ ID NO: 425209 - DNA, 24 bp, Artificial Sequence
  Description of Artificial Sequence: Synthetic oligonucleotide
gagggccatacccaggacacggag

SEQ ID NO: 425210 - DNA, 25 bp, Artificial Sequence
  Description of Artificial Sequence: Synthetic oligonucleotide
agggccatacccaggacacggagct

SEQ ID NO: 425211 - DNA, 24 bp, Artificial Sequence
  Description of Artificial Sequence: Synthetic oligonucleotide
gggccatacccaggacacggagct

SEQ ID NO: 425212 - DNA, 24 bp, Artificial Sequence
  Description of Artificial Sequence: Synthetic oligonucleotide
ggccatacccaggacacggagctc

SEQ ID NO: 425213 - DNA, 25 bp, Artificial Sequence
  Description of Artificial Sequence: Synthetic oligonucleotide
gccatacccaggacacggagctcgt

SEQ ID NO: 425214 - DNA, 25 bp, Artificial Sequence
  Description of Artificial Sequence: Synthetic oligonucleotide
ccatacccaggacacggagctcgtg

SEQ ID NO: 425215 - DNA, 26 bp, Artificial Sequence
  Description of Artificial Sequence: Synthetic oligonucleotide
catacccaggacacggagctcgtgga

SEQ ID NO: 425216 - DNA, 27 bp, Artificial Sequence
  Description of Artificial Sequence: Synthetic oligonucleotide
atacccaggacacggagctcgtggaga

SEQ ID NO: 425217 - DNA, 26 bp, Artificial Sequence
  Description of Artificial Sequence: Synthetic oligonucleotide
tacccaggacacggagctcgtggaga

SEQ ID NO: 425218 - DNA, 29 bp, Artificial Sequence
  Description of Artificial Sequence: Synthetic oligonucleotide
tgccttctggagaggagcagagatacacg

SEQ ID NO: 425219 - DNA, 28 bp, Artificial Sequence
  Description of Artificial Sequence: Synthetic oligonucleotide
gccttctggagaggagcagagatacacg

SEQ ID NO: 425220 - DNA, 29 bp, Artificial Sequence
  Description of Artificial Sequence: Synthetic oligonucleotide
ccttctggagaggagcagagatacacgtg

SEQ ID NO: 425221 - DNA, 29 bp, Artificial Sequence
  Description of Artificial Sequence: Synthetic oligonucleotide
cttctggagaggagcagagatacacgtgc

SEQ ID NO: 425222 - DNA, 29 bp, Artificial Sequence
  Description of Artificial Sequence: Synthetic oligonucleotide
ttctggagaggagcagagatacacgtgcc

SEQ ID NO: 425223 - DNA, 28 bp, Artificial Sequence
  Description of Artificial Sequence: Synthetic oligonucleotide
tctggagaggagcagagatacacgtgcc

SEQ ID NO: 425224 - DNA, 27 bp, Artificial Sequence
  Description of Artificial Sequence: Synthetic oligonucleotide
ctggagaggagcagagatacacgtgcc

SEQ ID NO: 425225 - DNA, 29 bp, Artificial Sequence
  Description of Artificial Sequence: Synthetic oligonucleotide
tggagaggagcagagatacacgtgccatg

SEQ ID NO: 425226 - DNA, 28 bp, Artificial Sequence
  Description of Artificial Sequence: Synthetic oligonucleotide
ggagaggagcagagatacacgtgccatg

SEQ ID NO: 425227 - DNA, 29 bp, Artificial Sequence
  Description of Artificial Sequence: Synthetic oligonucleotide
gagaggagcagagatacacgtgccatgtg

SEQ ID NO: 425228 - DNA, 29 bp, Artificial Sequence
  Description of Artificial Sequence: Synthetic oligonucleotide
agaggagcagagatacacgtgccatgtgc

SEQ ID NO: 425229 - DNA, 28 bp, Artificial Sequence
  Description of Artificial Sequence: Synthetic oligonucleotide
gaggagcagagatacacgtgccatgtgc

SEQ ID NO: 425230 - DNA, 29 bp, Artificial Sequence
  Description of Artificial Sequence: Synthetic oligonucleotide
aggagcagagatacacgtgccatgtgcag

SEQ ID NO: 425231 - DNA, 28 bp, Artificial Sequence
  Description of Artificial Sequence: Synthetic oligonucleotide
ggagcagagatacacgtgccatgtgcag

SEQ ID NO: 425232 - DNA, 27 bp, Artificial Sequence
  Description of Artificial Sequence: Synthetic oligonucleotide
acgtgccatgtgcagcatgaggggcta

SEQ ID NO: 425233 - DNA, 26 bp, Artificial Sequence
  Description of Artificial Sequence: Synthetic oligonucleotide
cgtgccatgtgcagcatgaggggcta

SEQ ID NO: 425234 - DNA, 26 bp, Artificial Sequence
  Description of Artificial Sequence: Synthetic oligonucleotide
gtgccatgtgcagcatgaggggctac

SEQ ID NO: 425235 - DNA, 26 bp, Artificial Sequence
  Description of Artificial Sequence: Synthetic oligonucleotide
tgccatgtgcagcatgaggggctacc

SEQ ID NO: 425236 - DNA, 25 bp, Artificial Sequence
  Description of Artificial Sequence: Synthetic oligonucleotide
gccatgtgcagcatgaggggctacc

SEQ ID NO: 425237 - DNA, 25 bp, Artificial Sequence
  Description of Artificial Sequence: Synthetic oligonucleotide
ccatgtgcagcatgaggggctaccc

SEQ ID NO: 425238 - DNA, 26 bp, Artificial Sequence
  Description of Artificial Sequence: Synthetic oligonucleotide
catgtgcagcatgaggggctacccga

SEQ ID NO: 425239 - DNA, 26 bp, Artificial Sequence
  Description of Artificial Sequence: Synthetic oligonucleotide
atgtgcagcatgaggggctacccgag

SEQ ID NO: 425240 - DNA, 25 bp, Artificial Sequence
  Description of Artificial Sequence: Synthetic oligonucleotide
tgtgcagcatgaggggctacccgag

SEQ ID NO: 425241 - DNA, 24 bp, Artificial Sequence
  Description of Artificial Sequence: Synthetic oligonucleotide
gtgcagcatgaggggctacccgag

SEQ ID NO: 425242 - DNA, 24 bp, Artificial Sequence
  Description of Artificial Sequence: Synthetic oligonucleotide
tgcagcatgaggggctacccgagc

SEQ ID NO: 425243 - DNA, 23 bp, Artificial Sequence
  Description of Artificial Sequence: Synthetic oligonucleotide
gcagcatgaggggctacccgagc

SEQ ID NO: 425244 - DNA, 23 bp, Artificial Sequence
  Description of Artificial Sequence: Synthetic oligonucleotide
cagcatgaggggctacccgagcc

SEQ ID NO: 425245 - DNA, 23 bp, Artificial Sequence
  Description of Artificial Sequence: Synthetic oligonucleotide
agcatgaggggctacccgagccc

SEQ ID NO: 425246 - DNA, 22 bp, Artificial Sequence
  Description of Artificial Sequence: Synthetic oligonucleotide
gcatgaggggctacccgagccc

SEQ ID NO: 425247 - DNA, 23 bp, Artificial Sequence
  Description of Artificial Sequence: Synthetic oligonucleotide
catgaggggctacccgagcccgt

SEQ ID NO: 425248 - DNA, 24 bp, Artificial Sequence
  Description of Artificial Sequence: Synthetic oligonucleotide
atgaggggctacccgagcccgtca

SEQ ID NO: 425249 - DNA, 23 bp, Artificial Sequence
  Description of Artificial Sequence: Synthetic oligonucleotide
tgaggggctacccgagcccgtca

SEQ ID NO: 425250 - DNA, 22 bp, Artificial Sequence
  Description of Artificial Sequence: Synthetic oligonucleotide
gaggggctacccgagcccgtca

SEQ ID NO: 425251 - DNA, 22 bp, Artificial Sequence
  Description of Artificial Sequence: Synthetic oligonucleotide
aggggctacccgagcccgtcac

SEQ ID NO: 425252 - DNA, 21 bp, Artificial Sequence
  Description of Artificial Sequence: Synthetic oligonucleotide
ggggctacccgagcccgtcac

SEQ ID NO: 425253 - DNA, 21 bp, Artificial Sequence
  Description of Artificial Sequence: Synthetic oligonucleotide
gggctacccgagcccgtcacc

SEQ ID NO: 425254 - DNA, 22 bp, Artificial Sequence
  Description of Artificial Sequence: Synthetic oligonucleotide
ggctacccgagcccgtcaccct

SEQ ID NO: 425255 - DNA, 23 bp, Artificial Sequence
  Description of Artificial Sequence: Synthetic oligonucleotide
gctacccgagcccgtcaccctga

SEQ ID NO: 425256 - DNA, 25 bp, Artificial Sequence
  Description of Artificial Sequence: Synthetic oligonucleotide
ctacccgagcccgtcaccctgagat

SEQ ID NO: 425257 - DNA, 25 bp, Artificial Sequence
  Description of Artificial Sequence: Synthetic oligonucleotide
tacccgagcccgtcaccctgagatg

SEQ ID NO: 425258 - DNA, 24 bp, Artificial Sequence
  Description of Artificial Sequence: Synthetic oligonucleotide
acccgagcccgtcaccctgagatg

SEQ ID NO: 425259 - DNA, 23 bp, Artificial Sequence
  Description of Artificial Sequence: Synthetic oligonucleotide
cccgagcccgtcaccctgagatg

SEQ ID NO: 425260 - DNA, 25 bp, Artificial Sequence
  Description of Artificial Sequence: Synthetic oligonucleotide
ccgagcccgtcaccctgagatggaa

SEQ ID NO: 425261 - DNA, 25 bp, Artificial Sequence
  Description of Artificial Sequence: Synthetic oligonucleotide
cgagcccgtcaccctgagatggaag

SEQ ID NO: 425262 - DNA, 25 bp, Artificial Sequence
  Description of Artificial Sequence: Synthetic oligonucleotide
gagcccgtcaccctgagatggaagc

SEQ ID NO: 425263 - DNA, 25 bp, Artificial Sequence
  Description of Artificial Sequence: Synthetic oligonucleotide
agcccgtcaccctgagatggaagcc

SEQ ID NO: 425264 - DNA, 24 bp, Artificial Sequence
  Description of Artificial Sequence: Synthetic oligonucleotide
gcccgtcaccctgagatggaagcc

SEQ ID NO: 425265 - DNA, 24 bp, Artificial Sequence
  Description of Artificial Sequence: Synthetic oligonucleotide
cccgtcaccctgagatggaagccg

SEQ ID NO: 425266 - DNA, 24 bp, Artificial Sequence
  Description of Artificial Sequence: Synthetic oligonucleotide
ccgtcaccctgagatggaagccgg

SEQ ID NO: 425267 - DNA, 26 bp, Artificial Sequence
  Description of Artificial Sequence: Synthetic oligonucleotide
cgtcaccctgagatggaagccggctt

SEQ ID NO: 425268 - DNA, 26 bp, Artificial Sequence
  Description of Artificial Sequence: Synthetic oligonucleotide
gtcaccctgagatggaagccggcttc

SEQ ID NO: 425269 - DNA, 26 bp, Artificial Sequence
  Description of Artificial Sequence: Synthetic oligonucleotide
tcaccctgagatggaagccggcttcc

SEQ ID NO: 425270 - DNA, 25 bp, Artificial Sequence
  Description of Artificial Sequence: Synthetic oligonucleotide
caccctgagatggaagccggcttcc

SEQ ID NO: 425271 - DNA, 26 bp, Artificial Sequence
  Description of Artificial Sequence: Synthetic oligonucleotide
accctgagatggaagccggcttccca

SEQ ID NO: 425272 - DNA, 25 bp, Artificial Sequence
  Description of Artificial Sequence: Synthetic oligonucleotide
ccctgagatggaagccggcttccca

SEQ ID NO: 425273 - DNA, 25 bp, Artificial Sequence
  Description of Artificial Sequence: Synthetic oligonucleotide
cctgagatggaagccggcttcccag

SEQ ID NO: 425274 - DNA, 25 bp, Artificial Sequence
  Description of Artificial Sequence: Synthetic oligonucleotide
ctgagatggaagccggcttcccagc

SEQ ID NO: 425275 - DNA, 25 bp, Artificial Sequence
  Description of Artificial Sequence: Synthetic oligonucleotide
tgagatggaagccggcttcccagcc

SEQ ID NO: 425276 - DNA, 24 bp, Artificial Sequence
  Description of Artificial Sequence: Synthetic oligonucleotide
gagatggaagccggcttcccagcc

SEQ ID NO: 425277 - DNA, 25 bp, Artificial Sequence
  Description of Artificial Sequence: Synthetic oligonucleotide
agatggaagccggcttcccagccca

SEQ ID NO: 425278 - DNA, 24 bp, Artificial Sequence
  Description of Artificial Sequence: Synthetic oligonucleotide
gatggaagccggcttcccagccca

SEQ ID NO: 425279 - DNA, 24 bp, Artificial Sequence
  Description of Artificial Sequence: Synthetic oligonucleotide
atggaagccggcttcccagcccac

SEQ ID NO: 425280 - DNA, 23 bp, Artificial Sequence
  Description of Artificial Sequence: Synthetic oligonucleotide
tggaagccggcttcccagcccac

SEQ ID NO: 425281 - DNA, 22 bp, Artificial Sequence
  Description of Artificial Sequence: Synthetic oligonucleotide
ggaagccggcttcccagcccac

SEQ ID NO: 425282 - DNA, 24 bp, Artificial Sequence
  Description of Artificial Sequence: Synthetic oligonucleotide
gaagccggcttcccagcccaccat

SEQ ID NO: 425283 - DNA, 24 bp, Artificial Sequence
  Description of Artificial Sequence: Synthetic oligonucleotide
aagccggcttcccagcccaccatc

SEQ ID NO: 425284 - DNA, 23 bp, Artificial Sequence
  Description of Artificial Sequence: Synthetic oligonucleotide
agccggcttcccagcccaccatc

SEQ ID NO: 425285 - DNA, 22 bp, Artificial Sequence
  Description of Artificial Sequence: Synthetic oligonucleotide
gccggcttcccagcccaccatc

SEQ ID NO: 425286 - DNA, 22 bp, Artificial Sequence
  Description of Artificial Sequence: Synthetic oligonucleotide
ccggcttcccagcccaccatcc

SEQ ID NO: 425287 - DNA, 22 bp, Artificial Sequence
  Description of Artificial Sequence: Synthetic oligonucleotide
cggcttcccagcccaccatccc

SEQ ID NO: 425288 - DNA, 24 bp, Artificial Sequence
  Description of Artificial Sequence: Synthetic oligonucleotide
ggcttcccagcccaccatccccat

SEQ ID NO: 425289 - DNA, 24 bp, Artificial Sequence
  Description of Artificial Sequence: Synthetic oligonucleotide
gcttcccagcccaccatccccatc

SEQ ID NO: 425290 - DNA, 30 bp, Artificial Sequence; identical to SEQ ID NO: 76185
  Description of Artificial Sequence: Synthetic oligonucleotide

SEQ ID NO: 425291 - DNA, 31 bp, Artificial Sequence; identical to SEQ ID NO: 76186
  Description of Artificial Sequence: Synthetic oligonucleotide

SEQ ID NO: 425292 - DNA, 30 bp, Artificial Sequence; identical to SEQ ID NO: 76187
  Description of Artificial Sequence: Synthetic oligonucleotide

SEQ ID NO: 425293 - DNA, 29 bp, Artificial Sequence
  Description of Artificial Sequence: Synthetic oligonucleotide
cattgctggcctggttctccttggatctg

SEQ ID NO: 425294 - DNA, 30 bp, Artificial Sequence; identical to SEQ ID NO: 76189
  Description of Artificial Sequence: Synthetic oligonucleotide

SEQ ID NO: 425295 - DNA, 29 bp, Artificial Sequence
  Description of Artificial Sequence: Synthetic oligonucleotide
ttgctggcctggttctccttggatctgtg

SEQ ID NO: 425296 - DNA, 28 bp, Artificial Sequence
  Description of Artificial Sequence: Synthetic oligonucleotide
tgctggcctggttctccttggatctgtg

SEQ ID NO: 425297 - DNA, 27 bp, Artificial Sequence
  Description of Artificial Sequence: Synthetic oligonucleotide
gctggcctggttctccttggatctgtg

SEQ ID NO: 425298 - DNA, 27 bp, Artificial Sequence
  Description of Artificial Sequence: Synthetic oligonucleotide
ctggcctggttctccttggatctgtgg

SEQ ID NO: 425299 - DNA, 28 bp, Artificial Sequence
  Description of Artificial Sequence: Synthetic oligonucleotide
tggcctggttctccttggatctgtggtc

SEQ ID NO: 425300 - DNA, 27 bp, Artificial Sequence
  Description of Artificial Sequence: Synthetic oligonucleotide
ggcctggttctccttggatctgtggtc

SEQ ID NO: 425301 - DNA, 28 bp, Artificial Sequence
  Description of Artificial Sequence: Synthetic oligonucleotide
gcctggttctccttggatctgtggtctc

SEQ ID NO: 425302 - DNA, 29 bp, Artificial Sequence
  Description of Artificial Sequence: Synthetic oligonucleotide
cctggttctccttggatctgtggtctctg

SEQ ID NO: 425303 - DNA, 29 bp, Artificial Sequence
  Description of Artificial Sequence: Synthetic oligonucleotide
ctggttctccttggatctgtggtctctgg

SEQ ID NO: 425304 - DNA, 30 bp, Artificial Sequence; identical to SEQ ID NO: 76199
  Description of Artificial Sequence: Synthetic oligonucleotide

SEQ ID NO: 425305 - DNA, 29 bp, Artificial Sequence
  Description of Artificial Sequence: Synthetic oligonucleotide
ggttctccttggatctgtggtctctggag

SEQ ID NO: 425306 - DNA, 29 bp, Artificial Sequence
  Description of Artificial Sequence: Synthetic oligonucleotide
gttctccttggatctgtggtctctggagc

SEQ ID NO: 425307 - DNA, 30 bp, Artificial Sequence; identical to SEQ ID NO: 76202
  Description of Artificial Sequence: Synthetic oligonucleotide

SEQ ID NO: 425308 - DNA, 29 bp, Artificial Sequence
  Description of Artificial Sequence: Synthetic oligonucleotide
tctccttggatctgtggtctctggagctg

SEQ ID NO: 425309 - DNA, 28 bp, Artificial Sequence
  Description of Artificial Sequence: Synthetic oligonucleotide
ctccttggatctgtggtctctggagctg

SEQ ID NO: 425310 - DNA, 29 bp, Artificial Sequence
  Description of Artificial Sequence: Synthetic oligonucleotide
tccttggatctgtggtctctggagctgtg

SEQ ID NO: 425311 - DNA, 28 bp, Artificial Sequence
  Description of Artificial Sequence: Synthetic oligonucleotide
ccttggatctgtggtctctggagctgtg

SEQ ID NO: 425312 - DNA, 28 bp, Artificial Sequence
  Description of Artificial Sequence: Synthetic oligonucleotide
cttggatctgtggtctctggagctgtgg

SEQ ID NO: 425313 - DNA, 30 bp, Artificial Sequence; identical to SEQ ID NO: 76208
  Description of Artificial Sequence: Synthetic oligonucleotide

SEQ ID NO: 425314 - DNA, 29 bp, Artificial Sequence
  Description of Artificial Sequence: Synthetic oligonucleotide
tggatctgtggtctctggagctgtggttg

SEQ ID NO: 425315 - DNA, 28 bp, Artificial Sequence
  Description of Artificial Sequence: Synthetic oligonucleotide
ggatctgtggtctctggagctgtggttg

SEQ ID NO: 425316 - DNA, 28 bp, Artificial Sequence
  Description of Artificial Sequence: Synthetic oligonucleotide
gatctgtggtctctggagctgtggttgc

SEQ ID NO: 425317 - DNA, 29 bp, Artificial Sequence
  Description of Artificial Sequence: Synthetic oligonucleotide
atctgtggtctctggagctgtggttgctg

SEQ ID NO: 425318 - DNA, 28 bp, Artificial Sequence
  Description of Artificial Sequence: Synthetic oligonucleotide
tctgtggtctctggagctgtggttgctg

SEQ ID NO: 425319 - DNA, 27 bp, Artificial Sequence
  Description of Artificial Sequence: Synthetic oligonucleotide
ctgtggtctctggagctgtggttgctg

SEQ ID NO: 425320 - DNA, 27 bp, Artificial Sequence
  Description of Artificial Sequence: Synthetic oligonucleotide
tgtggtctctggagctgtggttgctgc

SEQ ID NO: 425321 - DNA, 27 bp, Artificial Sequence
  Description of Artificial Sequence: Synthetic oligonucleotide
gtggtctctggagctgtggttgctgct

SEQ ID NO: 425322 - DNA, 27 bp, Artificial Sequence
  Description of Artificial Sequence: Synthetic oligonucleotide
tggtctctggagctgtggttgctgctg

SEQ ID NO: 425323 - DNA, 27 bp, Artificial Sequence
  Description of Artificial Sequence: Synthetic oligonucleotide
ggtctctggagctgtggttgctgctgt

SEQ ID NO: 425324 - DNA, 27 bp, Artificial Sequence
  Description of Artificial Sequence: Synthetic oligonucleotide
gtctctggagctgtggttgctgctgtg

SEQ ID NO: 425325 - DNA, 31 bp, Artificial Sequence; identical to SEQ ID NO: 76220
  Description of Artificial Sequence: Synthetic oligonucleotide

SEQ ID NO: 425326 - DNA, 30 bp, Artificial Sequence; identical to SEQ ID NO: 76221
  Description of Artificial Sequence: Synthetic oligonucleotide

SEQ ID NO: 425327 - DNA, 30 bp, Artificial Sequence; identical to SEQ ID NO: 76222
  Description of Artificial Sequence: Synthetic oligonucleotide

SEQ ID NO: 425328 - DNA, 29 bp, Artificial Sequence
  Description of Artificial Sequence: Synthetic oligonucleotide
ctggagctgtggttgctgctgtgatatgg

SEQ ID NO: 425329 - DNA, 30 bp, Artificial Sequence; identical to SEQ ID NO: 76224
  Description of Artificial Sequence: Synthetic oligonucleotide

SEQ ID NO: 425330 - DNA, 29 bp, Artificial Sequence
  Description of Artificial Sequence: Synthetic oligonucleotide
ggagctgtggttgctgctgtgatatggag

SEQ ID NO: 425331 - DNA, 29 bp, Artificial Sequence
  Description of Artificial Sequence: Synthetic oligonucleotide
gagctgtggttgctgctgtgatatggagg

SEQ ID NO: 425332 - DNA, 31 bp, Artificial Sequence; identical to SEQ ID NO: 76227
  Description of Artificial Sequence: Synthetic oligonucleotide

SEQ ID NO: 425333 - DNA, 30 bp, Artificial Sequence; identical to SEQ ID NO: 76228
  Description of Artificial Sequence: Synthetic oligonucleotide

SEQ ID NO: 425334 - DNA, 32 bp, Artificial Sequence; identical to SEQ ID NO: 76229
  Description of Artificial Sequence: Synthetic oligonucleotide

SEQ ID NO: 425335 - DNA, 33 bp, Artificial Sequence; identical to SEQ ID NO: 76230
  Description of Artificial Sequence: Synthetic oligonucleotide

SEQ ID NO: 425336 - DNA, 32 bp, Artificial Sequence; identical to SEQ ID NO: 76231
  Description of Artificial Sequence: Synthetic oligonucleotide

SEQ ID NO: 425337 - DNA, 32 bp, Artificial Sequence; identical to SEQ ID NO: 76232
  Description of Artificial Sequence: Synthetic oligonucleotide

SEQ ID NO: 425338 - DNA, 31 bp, Artificial Sequence; identical to SEQ ID NO: 76233
  Description of Artificial Sequence: Synthetic oligonucleotide

SEQ ID NO: 425339 - DNA, 32 bp, Artificial Sequence; identical to SEQ ID NO: 76234
  Description of Artificial Sequence: Synthetic oligonucleotide

SEQ ID NO: 425340 - DNA, 33 bp, Artificial Sequence; identical to SEQ ID NO: 76235
  Description of Artificial Sequence: Synthetic oligonucleotide

SEQ ID NO: 425341 - DNA, 32 bp, Artificial Sequence; identical to SEQ ID NO: 76236
  Description of Artificial Sequence: Synthetic oligonucleotide

SEQ ID NO: 425342 - DNA, 31 bp, Artificial Sequence; identical to SEQ ID NO: 76237
  Description of Artificial Sequence: Synthetic oligonucleotide

SEQ ID NO: 425343 - DNA, 31 bp, Artificial Sequence; identical to SEQ ID NO: 76238
  Description of Artificial Sequence: Synthetic oligonucleotide

SEQ ID NO: 425344 - DNA, 32 bp, Artificial Sequence; identical to SEQ ID NO: 76239
  Description of Artificial Sequence: Synthetic oligonucleotide

SEQ ID NO: 425345 - DNA, 31 bp, Artificial Sequence; identical to SEQ ID NO: 76240
  Description of Artificial Sequence: Synthetic oligonucleotide

SEQ ID NO: 425346 - DNA, 31 bp, Artificial Sequence; identical to SEQ ID NO: 76241
  Description of Artificial Sequence: Synthetic oligonucleotide

SEQ ID NO: 425347 - DNA, 35 bp, Artificial Sequence; identical to SEQ ID NO: 76242
  Description of Artificial Sequence: Synthetic oligonucleotide

SEQ ID NO: 425348 - DNA, 34 bp, Artificial Sequence; identical to SEQ ID NO: 76243
  Description of Artificial Sequence: Synthetic oligonucleotide

SEQ ID NO: 425349 - DNA, 34 bp, Artificial Sequence; identical to SEQ ID NO: 76244
  Description of Artificial Sequence: Synthetic oligonucleotide

SEQ ID NO: 425350 - DNA, 33 bp, Artificial Sequence; identical to SEQ ID NO: 76245
  Description of Artificial Sequence: Synthetic oligonucleotide

SEQ ID NO: 425351 - DNA, 34 bp, Artificial Sequence; identical to SEQ ID NO: 76246
  Description of Artificial Sequence: Synthetic oligonucleotide

SEQ ID NO: 425352 - DNA, 33 bp, Artificial Sequence; identical to SEQ ID NO: 76247
  Description of Artificial Sequence: Synthetic oligonucleotide

SEQ ID NO: 425353 - DNA, 32 bp, Artificial Sequence; identical to SEQ ID NO: 76248
  Description of Artificial Sequence: Synthetic oligonucleotide

SEQ ID NO: 425354 - DNA, 31 bp, Artificial Sequence; identical to SEQ ID NO: 76249
  Description of Artificial Sequence: Synthetic oligonucleotide

SEQ ID NO: 425355 - DNA, 30 bp, Artificial Sequence; identical to SEQ ID NO: 76250
  Description of Artificial Sequence: Synthetic oligonucleotide

SEQ ID NO: 425356 - DNA, 30 bp, Artificial Sequence; identical to SEQ ID NO: 76251
  Description of Artificial Sequence: Synthetic oligonucleotide

SEQ ID NO: 425357 - DNA, 30 bp, Artificial Sequence; identical to SEQ ID NO: 76252
  Description of Artificial Sequence: Synthetic oligonucleotide

SEQ ID NO: 425358 - DNA, 29 bp, Artificial Sequence
  Description of Artificial Sequence: Synthetic oligonucleotide
ggaagaagagctcaggtggaaaaggaggg

SEQ ID NO: 425359 - DNA, 30 bp, Artificial Sequence; identical to SEQ ID NO: 76254
  Description of Artificial Sequence: Synthetic oligonucleotide

SEQ ID NO: 425360 - DNA, 30 bp, Artificial Sequence; identical to SEQ ID NO: 76255
  Description of Artificial Sequence: Synthetic oligonucleotide

SEQ ID NO: 425361 - DNA, 29 bp, Artificial Sequence
  Description of Artificial Sequence: Synthetic oligonucleotide
agaagagctcaggtggaaaaggagggagc

SEQ ID NO: 425362 - DNA, 31 bp, Artificial Sequence; identical to SEQ ID NO: 76257
  Description of Artificial Sequence: Synthetic oligonucleotide

SEQ ID NO: 425363 - DNA, 31 bp, Artificial Sequence; identical to SEQ ID NO: 76258
  Description of Artificial Sequence: Synthetic oligonucleotide

SEQ ID NO: 425364 - DNA, 30 bp, Artificial Sequence; identical to SEQ ID NO: 76259
  Description of Artificial Sequence: Synthetic oligonucleotide

SEQ ID NO: 425365 - DNA, 30 bp, Artificial Sequence; identical to SEQ ID NO: 76260
  Description of Artificial Sequence: Synthetic oligonucleotide

SEQ ID NO: 425366 - DNA, 29 bp, Artificial Sequence
  Description of Artificial Sequence: Synthetic oligonucleotide
ggtggaaaaggagggagctactctaaggc

SEQ ID NO: 425367 - DNA, 30 bp, Artificial Sequence; identical to SEQ ID NO: 76262
  Description of Artificial Sequence: Synthetic oligonucleotide

SEQ ID NO: 425368 - DNA, 31 bp, Artificial Sequence; identical to SEQ ID NO: 76263
  Description of Artificial Sequence: Synthetic oligonucleotide

SEQ ID NO: 425369 - DNA, 30 bp, Artificial Sequence; identical to SEQ ID NO: 76264
  Description of Artificial Sequence: Synthetic oligonucleotide

SEQ ID NO: 425370 - DNA, 31 bp, Artificial Sequence; identical to SEQ ID NO: 76265
  Description of Artificial Sequence: Synthetic oligonucleotide

SEQ ID NO: 425371 - DNA, 31 bp, Artificial Sequence; identical to SEQ ID NO: 76266
  Description of Artificial Sequence: Synthetic oligonucleotide

SEQ ID NO: 425372 - DNA, 30 bp, Artificial Sequence; identical to SEQ ID NO: 76267
  Description of Artificial Sequence: Synthetic oligonucleotide

SEQ ID NO: 425373 - DNA, 29 bp, Artificial Sequence
  Description of Artificial Sequence: Synthetic oligonucleotide
aaggagggagctactctaaggctgagtgg

SEQ ID NO: 425374 - DNA, 28 bp, Artificial Sequence
  Description of Artificial Sequence: Synthetic oligonucleotide
aggagggagctactctaaggctgagtgg

SEQ ID NO: 425375 - DNA, 27 bp, Artificial Sequence
  Description of Artificial Sequence: Synthetic oligonucleotide
ggagggagctactctaaggctgagtgg

SEQ ID NO: 425376 - DNA, 28 bp, Artificial Sequence
  Description of Artificial Sequence: Synthetic oligonucleotide
gagggagctactctaaggctgagtggag

SEQ ID NO: 425377 - DNA, 28 bp, Artificial Sequence
  Description of Artificial Sequence: Synthetic oligonucleotide
agggagctactctaaggctgagtggagc

SEQ ID NO: 425378 - DNA, 27 bp, Artificial Sequence
  Description of Artificial Sequence: Synthetic oligonucleotide
gggagctactctaaggctgagtggagc

SEQ ID NO: 425379 - DNA, 27 bp, Artificial Sequence
  Description of Artificial Sequence: Synthetic oligonucleotide
ggagctactctaaggctgagtggagcg

SEQ ID NO: 425380 - DNA, 28 bp, Artificial Sequence
  Description of Artificial Sequence: Synthetic oligonucleotide
gagctactctaaggctgagtggagcgac

SEQ ID NO: 425381 - DNA, 29 bp, Artificial Sequence
  Description of Artificial Sequence: Synthetic oligonucleotide
agctactctaaggctgagtggagcgacag

SEQ ID NO: 425382 - DNA, 28 bp, Artificial Sequence
  Description of Artificial Sequence: Synthetic oligonucleotide
gctactctaaggctgagtggagcgacag

SEQ ID NO: 425383 - DNA, 29 bp, Artificial Sequence
  Description of Artificial Sequence: Synthetic oligonucleotide
ctactctaaggctgagtggagcgacagtg

SEQ ID NO: 425384 - DNA, 29 bp, Artificial Sequence
  Description of Artificial Sequence: Synthetic oligonucleotide
tactctaaggctgagtggagcgacagtgc

SEQ ID NO: 425385 - DNA, 28 bp, Artificial Sequence
  Description of Artificial Sequence: Synthetic oligonucleotide
actctaaggctgagtggagcgacagtgc

SEQ ID NO: 425386 - DNA, 27 bp, Artificial Sequence
  Description of Artificial Sequence: Synthetic oligonucleotide
ctctaaggctgagtggagcgacagtgc

SEQ ID NO: 425387 - DNA, 27 bp, Artificial Sequence
  Description of Artificial Sequence: Synthetic oligonucleotide
tctaaggctgagtggagcgacagtgcc

SEQ ID NO: 425388 - DNA, 26 bp, Artificial Sequence
  Description of Artificial Sequence: Synthetic oligonucleotide
ctaaggctgagtggagcgacagtgcc

SEQ ID NO: 425389 - DNA, 27 bp, Artificial Sequence
  Description of Artificial Sequence: Synthetic oligonucleotide
taaggctgagtggagcgacagtgccca

SEQ ID NO: 425390 - DNA, 26 bp, Artificial Sequence
  Description of Artificial Sequence: Synthetic oligonucleotide
aaggctgagtggagcgacagtgccca

SEQ ID NO: 425391 - DNA, 25 bp, Artificial Sequence
  Description of Artificial Sequence: Synthetic oligonucleotide
aggctgagtggagcgacagtgccca

SEQ ID NO: 425392 - DNA, 24 bp, Artificial Sequence
  Description of Artificial Sequence: Synthetic oligonucleotide
ggctgagtggagcgacagtgccca

SEQ ID NO: 425393 - DNA, 24 bp, Artificial Sequence
  Description of Artificial Sequence: Synthetic oligonucleotide
gctgagtggagcgacagtgcccag

SEQ ID NO: 425394 - DNA, 24 bp, Artificial Sequence
  Description of Artificial Sequence: Synthetic oligonucleotide
ctgagtggagcgacagtgcccagg

SEQ ID NO: 425395 - DNA, 24 bp, Artificial Sequence
  Description of Artificial Sequence: Synthetic oligonucleotide
tgagtggagcgacagtgcccaggg

SEQ ID NO: 425396 - DNA, 23 bp, Artificial Sequence
  Description of Artificial Sequence: Synthetic oligonucleotide
gagtggagcgacagtgcccaggg

SEQ ID NO: 425397 - DNA, 24 bp, Artificial Sequence
  Description of Artificial Sequence: Synthetic oligonucleotide
agtggagcgacagtgcccaggggt

SEQ ID NO: 425398 - DNA, 23 bp, Artificial Sequence
  Description of Artificial Sequence: Synthetic oligonucleotide
gtggagcgacagtgcccaggggt

SEQ ID NO: 425399 - DNA, 24 bp, Artificial Sequence
  Description of Artificial Sequence: Synthetic oligonucleotide
tggagcgacagtgcccaggggtct

SEQ ID NO: 425400 - DNA, 23 bp, Artificial Sequence
  Description of Artificial Sequence: Synthetic oligonucleotide
ggagcgacagtgcccaggggtct

SEQ ID NO: 425401 - DNA, 24 bp, Artificial Sequence
  Description of Artificial Sequence: Synthetic oligonucleotide
gagcgacagtgcccaggggtctga

SEQ ID NO: 425402 - DNA, 25 bp, Artificial Sequence
  Description of Artificial Sequence: Synthetic oligonucleotide
agcgacagtgcccaggggtctgagt

SEQ ID NO: 425403 - DNA, 24 bp, Artificial Sequence
  Description of Artificial Sequence: Synthetic oligonucleotide
gcgacagtgcccaggggtctgagt

SEQ ID NO: 425404 - DNA, 25 bp, Artificial Sequence
  Description of Artificial Sequence: Synthetic oligonucleotide
cgacagtgcccaggggtctgagtct

SEQ ID NO: 425405 - DNA, 26 bp, Artificial Sequence
  Description of Artificial Sequence: Synthetic oligonucleotide
gacagtgcccaggggtctgagtctca

SEQ ID NO: 425406 - DNA, 27 bp, Artificial Sequence
  Description of Artificial Sequence: Synthetic oligonucleotide
acagtgcccaggggtctgagtctcaca

SEQ ID NO: 425407 - DNA, 26 bp, Artificial Sequence
  Description of Artificial Sequence: Synthetic oligonucleotide
cagtgcccaggggtctgagtctcaca

SEQ ID NO: 425408 - DNA, 26 bp, Artificial Sequence
  Description of Artificial Sequence: Synthetic oligonucleotide
agtgcccaggggtctgagtctcacag

SEQ ID NO: 425409 - DNA, 25 bp, Artificial Sequence
  Description of Artificial Sequence: Synthetic oligonucleotide
gtgcccaggggtctgagtctcacag

SEQ ID NO: 425410 - DNA, 27 bp, Artificial Sequence
  Description of Artificial Sequence: Synthetic oligonucleotide
tgcccaggggtctgagtctcacagctt

SEQ ID NO: 425411 - DNA, 26 bp, Artificial Sequence
  Description of Artificial Sequence: Synthetic oligonucleotide
gcccaggggtctgagtctcacagctt

SEQ ID NO: 425412 - DNA, 27 bp, Artificial Sequence
  Description of Artificial Sequence: Synthetic oligonucleotide
cccaggggtctgagtctcacagcttgt

SEQ ID NO: 425413 - DNA, 41 bp, Artificial Sequence
  Description of Artificial Sequence: Synthetic oligonucleotide
gaaacctaaaagtttaagaactgctgattgctgggaaactg

SEQ ID NO: 425414 - DNA, 41 bp, Artificial Sequence
  Description of Artificial Sequence: Synthetic oligonucleotide
aaacctaaaagtttaagaactgctgattgctgggaaactgc

SEQ ID NO: 425415 - DNA, 40 bp, Artificial Sequence
  Description of Artificial Sequence: Synthetic oligonucleotide
aacctaaaagtttaagaactgctgattgctgggaaactgc

SEQ ID NO: 425416 - DNA, 39 bp, Artificial Sequence
  Description of Artificial Sequence: Synthetic oligonucleotide
acctaaaagtttaagaactgctgattgctgggaaactgc

SEQ ID NO: 425417 - DNA, 38 bp, Artificial Sequence
  Description of Artificial Sequence: Synthetic oligonucleotide
cctaaaagtttaagaactgctgattgctgggaaactgc

SEQ ID NO: 425418 - DNA, 39 bp, Artificial Sequence
  Description of Artificial Sequence: Synthetic oligonucleotide
ctaaaagtttaagaactgctgattgctgggaaactgcag

SEQ ID NO: 425419 - DNA, 42 bp, Artificial Sequence
  Description of Artificial Sequence: Synthetic oligonucleotide
taaaagtttaagaactgctgattgctgggaaactgcagtttc

SEQ ID NO: 425420 - DNA, 41 bp, Artificial Sequence
  Description of Artificial Sequence: Synthetic oligonucleotide
aaaagtttaagaactgctgattgctgggaaactgcagtttc

SEQ ID NO: 425421 - DNA, 40 bp, Artificial Sequence
  Description of Artificial Sequence: Synthetic oligonucleotide
aaagtttaagaactgctgattgctgggaaactgcagtttc

SEQ ID NO: 425422 - DNA, 39 bp, Artificial Sequence
  Description of Artificial Sequence: Synthetic oligonucleotide
aagtttaagaactgctgattgctgggaaactgcagtttc

SEQ ID NO: 425423 - DNA, 38 bp, Artificial Sequence
  Description of Artificial Sequence: Synthetic oligonucleotide
agtttaagaactgctgattgctgggaaactgcagtttc

SEQ ID NO: 425424 - DNA, 37 bp, Artificial Sequence
  Description of Artificial Sequence: Synthetic oligonucleotide
gtttaagaactgctgattgctgggaaactgcagtttc

SEQ ID NO: 425425 - DNA, 37 bp, Artificial Sequence
  Description of Artificial Sequence: Synthetic oligonucleotide
tttaagaactgctgattgctgggaaactgcagtttcc

SEQ ID NO: 425426 - DNA, 36 bp, Artificial Sequence
  Description of Artificial Sequence: Synthetic oligonucleotide
ttaagaactgctgattgctgggaaactgcagtttcc

SEQ ID NO: 425427 - DNA, 35 bp, Artificial Sequence
  Description of Artificial Sequence: Synthetic oligonucleotide
taagaactgctgattgctgggaaactgcagtttcc

SEQ ID NO: 425428 - DNA, 34 bp, Artificial Sequence
  Description of Artificial Sequence: Synthetic oligonucleotide
aagaactgctgattgctgggaaactgcagtttcc

SEQ ID NO: 425429 - DNA, 33 bp, Artificial Sequence
  Description of Artificial Sequence: Synthetic oligonucleotide
agaactgctgattgctgggaaactgcagtttcc

SEQ ID NO: 425430 - DNA, 32 bp, Artificial Sequence
  Description of Artificial Sequence: Synthetic oligonucleotide
gaactgctgattgctgggaaactgcagtttcc

SEQ ID NO: 425431 - DNA, 32 bp, Artificial Sequence
  Description of Artificial Sequence: Synthetic oligonucleotide
aactgctgattgctgggaaactgcagtttccc

SEQ ID NO: 425432 - DNA, 31 bp, Artificial Sequence
  Description of Artificial Sequence: Synthetic oligonucleotide
actgctgattgctgggaaactgcagtttccc

SEQ ID NO: 425433 - DNA, 30 bp, Artificial Sequence
  Description of Artificial Sequence: Synthetic oligonucleotide
ctgctgattgctgggaaactgcagtttccc

SEQ ID NO: 425434 - DNA, 30 bp, Artificial Sequence
  Description of Artificial Sequence: Synthetic oligonucleotide
tgctgattgctgggaaactgcagtttcccg

SEQ ID NO: 425435 - DNA, 29 bp, Artificial Sequence
  Description of Artificial Sequence: Synthetic oligonucleotide
gctgattgctgggaaactgcagtttcccg

SEQ ID NO: 425436 - DNA, 31 bp, Artificial Sequence
  Description of Artificial Sequence: Synthetic oligonucleotide
ctgattgctgggaaactgcagtttcccgttc

SEQ ID NO: 425437 - DNA, 31 bp, Artificial Sequence
  Description of Artificial Sequence: Synthetic oligonucleotide
tgattgctgggaaactgcagtttcccgttcc

SEQ ID NO: 425438 - DNA, 30 bp, Artificial Sequence
  Description of Artificial Sequence: Synthetic oligonucleotide
gattgctgggaaactgcagtttcccgttcc

SEQ ID NO: 425439 - DNA, 31 bp, Artificial Sequence
  Description of Artificial Sequence: Synthetic oligonucleotide
attgctgggaaactgcagtttcccgttcctc

SEQ ID NO: 425440 - DNA, 30 bp, Artificial Sequence
  Description of Artificial Sequence: Synthetic oligonucleotide
ttgctgggaaactgcagtttcccgttcctc

SEQ ID NO: 425441 - DNA, 29 bp, Artificial Sequence
  Description of Artificial Sequence: Synthetic oligonucleotide
tgctgggaaactgcagtttcccgttcctc

SEQ ID NO: 425442 - DNA, 28 bp, Artificial Sequence
  Description of Artificial Sequence: Synthetic oligonucleotide
gctgggaaactgcagtttcccgttcctc

SEQ ID NO: 425443 - DNA, 29 bp, Artificial Sequence
  Description of Artificial Sequence: Synthetic oligonucleotide
ctgggaaactgcagtttcccgttcctctc

SEQ ID NO: 425444 - DNA, 29 bp, Artificial Sequence
  Description of Artificial Sequence: Synthetic oligonucleotide
tgggaaactgcagtttcccgttcctctcg

SEQ ID NO: 425445 - DNA, 28 bp, Artificial Sequence
  Description of Artificial Sequence: Synthetic oligonucleotide
gggaaactgcagtttcccgttcctctcg

SEQ ID NO: 425446 - DNA, 31 bp, Artificial Sequence
  Description of Artificial Sequence: Synthetic oligonucleotide
ggaaactgcagtttcccgttcctctcgtaac

SEQ ID NO: 425447 - DNA, 31 bp, Artificial Sequence
  Description of Artificial Sequence: Synthetic oligonucleotide
gaaactgcagtttcccgttcctctcgtaacc

SEQ ID NO: 425448 - DNA, 32 bp, Artificial Sequence
  Description of Artificial Sequence: Synthetic oligonucleotide
aaactgcagtttcccgttcctctcgtaacctg

SEQ ID NO: 425449 - DNA, 31 bp, Artificial Sequence
  Description of Artificial Sequence: Synthetic oligonucleotide
aactgcagtttcccgttcctctcgtaacctg

SEQ ID NO: 425450 - DNA, 30 bp, Artificial Sequence
  Description of Artificial Sequence: Synthetic oligonucleotide
actgcagtttcccgttcctctcgtaacctg

SEQ ID NO: 425451 - DNA, 20 bp, Artificial Sequence
  Description of Artificial Sequence: Synthetic oligonucleotide
gctgcgagctggggcccgac

SEQ ID NO: 425452 - DNA, 20 bp, Artificial Sequence
  Description of Artificial Sequence: Synthetic oligonucleotide
ctgcgagctggggcccgacg

SEQ ID NO: 425453 - DNA, 20 bp, Artificial Sequence
  Description of Artificial Sequence: Synthetic oligonucleotide
tgcgagctggggcccgacgg

SEQ ID NO: 425454 - DNA, 20 bp, Artificial Sequence
  Description of Artificial Sequence: Synthetic oligonucleotide
gcgagctggggcccgacggt

SEQ ID NO: 425455 - DNA, 20 bp, Artificial Sequence
  Description of Artificial Sequence: Synthetic oligonucleotide
cgagctggggcccgacgggt

SEQ ID NO: 425456 - DNA, 20 bp, Artificial Sequence
  Description of Artificial Sequence: Synthetic oligonucleotide
gagctggggcccgacgggct

SEQ ID NO: 425457 - DNA, 20 bp, Artificial Sequence
  Description of Artificial Sequence: Synthetic oligonucleotide
agctggggcccgacgggcgt

SEQ ID NO: 425458 - DNA, 20 bp, Artificial Sequence
  Description of Artificial Sequence: Synthetic oligonucleotide
gctggggcccgacgggcgtt

SEQ ID NO: 425459 - DNA, 31 bp, Artificial Sequence; identical to SEQ ID NO: 76316
  Description of Artificial Sequence: Synthetic oligonucleotide

SEQ ID NO: 425460 - DNA, 30 bp, Artificial Sequence; identical to SEQ ID NO: 76317
  Description of Artificial Sequence: Synthetic oligonucleotide

SEQ ID NO: 425461 - DNA, 31 bp, Artificial Sequence; identical to SEQ ID NO: 76318
  Description of Artificial Sequence: Synthetic oligonucleotide

SEQ ID NO: 425462 - DNA, 31 bp, Artificial Sequence; identical to SEQ ID NO: 76319
  Description of Artificial Sequence: Synthetic oligonucleotide

SEQ ID NO: 425463 - DNA, 31 bp, Artificial Sequence; identical to SEQ ID NO: 76320
  Description of Artificial Sequence: Synthetic oligonucleotide

SEQ ID NO: 425464 - DNA, 30 bp, Artificial Sequence; identical to SEQ ID NO: 76321
  Description of Artificial Sequence: Synthetic oligonucleotide

SEQ ID NO: 425465 - DNA, 30 bp, Artificial Sequence; identical to SEQ ID NO: 76322
  Description of Artificial Sequence: Synthetic oligonucleotide

SEQ ID NO: 425466 - DNA, 29 bp, Artificial Sequence
  Description of Artificial Sequence: Synthetic oligonucleotide
ccgcacagattttccgagtgaatctgcgg

SEQ ID NO: 425467 - DNA, 30 bp, Artificial Sequence; identical to SEQ ID NO: 76324
  Description of Artificial Sequence: Synthetic oligonucleotide

SEQ ID NO: 425468 - DNA, 30 bp, Artificial Sequence; identical to SEQ ID NO: 76325
  Description of Artificial Sequence: Synthetic oligonucleotide

SEQ ID NO: 425469 - DNA, 30 bp, Artificial Sequence; identical to SEQ ID NO: 76326
  Description of Artificial Sequence: Synthetic oligonucleotide

SEQ ID NO: 425470 - DNA, 31 bp, Artificial Sequence; identical to SEQ ID NO: 76327
  Description of Artificial Sequence: Synthetic oligonucleotide

SEQ ID NO: 425471 - DNA, 30 bp, Artificial Sequence; identical to SEQ ID NO: 76328
  Description of Artificial Sequence: Synthetic oligonucleotide

SEQ ID NO: 425472 - DNA, 30 bp, Artificial Sequence; identical to SEQ ID NO: 76329
  Description of Artificial Sequence: Synthetic oligonucleotide

SEQ ID NO: 425473 - DNA, 29 bp, Artificial Sequence
  Description of Artificial Sequence: Synthetic oligonucleotide
gattttccgagtgaatctgcggacgctgc

SEQ ID NO: 425474 - DNA, 29 bp, Artificial Sequence
  Description of Artificial Sequence: Synthetic oligonucleotide
attttccgagtgaatctgcggacgctgcg

SEQ ID NO: 425475 - DNA, 28 bp, Artificial Sequence
  Description of Artificial Sequence: Synthetic oligonucleotide
ttttccgagtgaatctgcggacgctgcg

SEQ ID NO: 425476 - DNA, 27 bp, Artificial Sequence
  Description of Artificial Sequence: Synthetic oligonucleotide
tttccgagtgaatctgcggacgctgcg

SEQ ID NO: 425477 - DNA, 26 bp, Artificial Sequence
  Description of Artificial Sequence: Synthetic oligonucleotide
ttccgagtgaatctgcggacgctgcg

SEQ ID NO: 425478 - DNA, 25 bp, Artificial Sequence
  Description of Artificial Sequence: Synthetic oligonucleotide
tccgagtgaatctgcggacgctgcg

SEQ ID NO: 425479 - DNA, 24 bp, Artificial Sequence
  Description of Artificial Sequence: Synthetic oligonucleotide
ccgagtgaatctgcggacgctgcg

SEQ ID NO: 425480 - DNA, 24 bp, Artificial Sequence
  Description of Artificial Sequence: Synthetic oligonucleotide
cgagtgaatctgcggacgctgcgc

SEQ ID NO: 425481 - DNA, 24 bp, Artificial Sequence
  Description of Artificial Sequence: Synthetic oligonucleotide
gagtgaatctgcggacgctgcgcg

SEQ ID NO: 425482 - DNA, 24 bp, Artificial Sequence
  Description of Artificial Sequence: Synthetic oligonucleotide
agtgaatctgcggacgctgcgcgg

SEQ ID NO: 425483 - DNA, 23 bp, Artificial Sequence
  Description of Artificial Sequence: Synthetic oligonucleotide
gtgaatctgcggacgctgcgcgg

SEQ ID NO: 425484 - DNA, 25 bp, Artificial Sequence
  Description of Artificial Sequence: Synthetic oligonucleotide
tgaatctgcggacgctgcgcggcta

SEQ ID NO: 425485 - DNA, 24 bp, Artificial Sequence
  Description of Artificial Sequence: Synthetic oligonucleotide
gaatctgcggacgctgcgcggcta

SEQ ID NO: 425486 - DNA, 26 bp, Artificial Sequence
  Description of Artificial Sequence: Synthetic oligonucleotide
aatctgcggacgctgcgcggctacta

SEQ ID NO: 425487 - DNA, 25 bp, Artificial Sequence
  Description of Artificial Sequence: Synthetic oligonucleotide
atctgcggacgctgcgcggctacta

SEQ ID NO: 425488 - DNA, 24 bp, Artificial Sequence
  Description of Artificial Sequence: Synthetic oligonucleotide
tctgcggacgctgcgcggctacta

SEQ ID NO: 425489 - DNA, 35 bp, Artificial Sequence; identical to SEQ ID NO: 76346
  Description of Artificial Sequence: Synthetic oligonucleotide

SEQ ID NO: 425490 - DNA, 36 bp, Artificial Sequence; identical to SEQ ID NO: 76347
  Description of Artificial Sequence: Synthetic oligonucleotide

SEQ ID NO: 425491 - DNA, 37 bp, Artificial Sequence; identical to SEQ ID NO: 76348
  Description of Artificial Sequence: Synthetic oligonucleotide

SEQ ID NO: 425492 - DNA, 36 bp, Artificial Sequence; identical to SEQ ID NO: 76349
  Description of Artificial Sequence: Synthetic oligonucleotide

SEQ ID NO: 425493 - DNA, 36 bp, Artificial Sequence; identical to SEQ ID NO: 76350
  Description of Artificial Sequence: Synthetic oligonucleotide

SEQ ID NO: 425494 - DNA, 35 bp, Artificial Sequence; identical to SEQ ID NO: 76351
  Description of Artificial Sequence: Synthetic oligonucleotide

SEQ ID NO: 425495 - DNA, 35 bp, Artificial Sequence; identical to SEQ ID NO: 76352
  Description of Artificial Sequence: Synthetic oligonucleotide

SEQ ID NO: 425496 - DNA, 34 bp, Artificial Sequence; identical to SEQ ID NO: 76353
  Description of Artificial Sequence: Synthetic oligonucleotide

SEQ ID NO: 425497 - DNA, 33 bp, Artificial Sequence; identical to SEQ ID NO: 76354
  Description of Artificial Sequence: Synthetic oligonucleotide

SEQ ID NO: 425498 - DNA, 33 bp, Artificial Sequence; identical to SEQ ID NO: 76355
  Description of Artificial Sequence: Synthetic oligonucleotide

SEQ ID NO: 425499 - DNA, 32 bp, Artificial Sequence; identical to SEQ ID NO: 76356
  Description of Artificial Sequence: Synthetic oligonucleotide

SEQ ID NO: 425500 - DNA, 32 bp, Artificial Sequence; identical to SEQ ID NO: 76357
  Description of Artificial Sequence: Synthetic oligonucleotide

SEQ ID NO: 425501 - DNA, 33 bp, Artificial Sequence; identical to SEQ ID NO: 76358
  Description of Artificial Sequence: Synthetic oligonucleotide

SEQ ID NO: 425502 - DNA, 33 bp, Artificial Sequence; identical to SEQ ID NO: 76359
  Description of Artificial Sequence: Synthetic oligonucleotide

SEQ ID NO: 425503 - DNA, 32 bp, Artificial Sequence; identical to SEQ ID NO: 76360
  Description of Artificial Sequence: Synthetic oligonucleotide

SEQ ID NO: 425504 - DNA, 33 bp, Artificial Sequence; identical to SEQ ID NO: 76361
  Description of Artificial Sequence: Synthetic oligonucleotide

SEQ ID NO: 425505 - DNA, 33 bp, Artificial Sequence; identical to SEQ ID NO: 76362
  Description of Artificial Sequence: Synthetic oligonucleotide

SEQ ID NO: 425506 - DNA, 32 bp, Artificial Sequence; identical to SEQ ID NO: 76363
  Description of Artificial Sequence: Synthetic oligonucleotide

SEQ ID NO: 425507 - DNA, 31 bp, Artificial Sequence; identical to SEQ ID NO: 76364
  Description of Artificial Sequence: Synthetic oligonucleotide

SEQ ID NO: 425508 - DNA, 30 bp, Artificial Sequence; identical to SEQ ID NO: 76365
  Description of Artificial Sequence: Synthetic oligonucleotide

SEQ ID NO: 425509 - DNA, 29 bp, Artificial Sequence
  Description of Artificial Sequence: Synthetic oligonucleotide
gtcaaatgatgcttctgaggcggagcacc

SEQ ID NO: 425510 - DNA, 30 bp, Artificial Sequence; identical to SEQ ID NO: 76367
  Description of Artificial Sequence: Synthetic oligonucleotide

SEQ ID NO: 425511 - DNA, 29 bp, Artificial Sequence
  Description of Artificial Sequence: Synthetic oligonucleotide
caaatgatgcttctgaggcggagcaccag

SEQ ID NO: 425512 - DNA, 30 bp, Artificial Sequence; identical to SEQ ID NO: 76369
  Description of Artificial Sequence: Synthetic oligonucleotide

SEQ ID NO: 425513 - DNA, 29 bp, Artificial Sequence
  Description of Artificial Sequence: Synthetic oligonucleotide
aatgatgcttctgaggcggagcaccagag

SEQ ID NO: 425514 - DNA, 28 bp, Artificial Sequence
  Description of Artificial Sequence: Synthetic oligonucleotide
atgatgcttctgaggcggagcaccagag

SEQ ID NO: 425515 - DNA, 27 bp, Artificial Sequence
  Description of Artificial Sequence: Synthetic oligonucleotide
tgatgcttctgaggcggagcaccagag

SEQ ID NO: 425516 - DNA, 27 bp, Artificial Sequence
  Description of Artificial Sequence: Synthetic oligonucleotide
gatgcttctgaggcggagcaccagaga

SEQ ID NO: 425517 - DNA, 27 bp, Artificial Sequence
  Description of Artificial Sequence: Synthetic oligonucleotide
atgcttctgaggcggagcaccagagag

SEQ ID NO: 425518 - DNA, 26 bp, Artificial Sequence
  Description of Artificial Sequence: Synthetic oligonucleotide
tgcttctgaggcggagcaccagagag

SEQ ID NO: 425519 - DNA, 25 bp, Artificial Sequence
  Description of Artificial Sequence: Synthetic oligonucleotide
gcttctgaggcggagcaccagagag

SEQ ID NO: 425520 - DNA, 25 bp, Artificial Sequence
  Description of Artificial Sequence: Synthetic oligonucleotide
cttctgaggcggagcaccagagagc

SEQ ID NO: 425521 - DNA, 27 bp, Artificial Sequence
  Description of Artificial Sequence: Synthetic oligonucleotide
ttctgaggcggagcaccagagagccta

SEQ ID NO: 425522 - DNA, 24 bp, Artificial Sequence
  Description of Artificial Sequence: Synthetic oligonucleotide
tgggccctgggcttctaccctgca

SEQ ID NO: 425523 - DNA, 23 bp, Artificial Sequence
  Description of Artificial Sequence: Synthetic oligonucleotide
gggccctgggcttctaccctgca

SEQ ID NO: 425524 - DNA, 24 bp, Artificial Sequence
  Description of Artificial Sequence: Synthetic oligonucleotide
ggccctgggcttctaccctgcaga

SEQ ID NO: 425525 - DNA, 26 bp, Artificial Sequence
  Description of Artificial Sequence: Synthetic oligonucleotide
gccctgggcttctaccctgcagagat

SEQ ID NO: 425526 - DNA, 27 bp, Artificial Sequence
  Description of Artificial Sequence: Synthetic oligonucleotide
ccctgggcttctaccctgcagagatca

SEQ ID NO: 425527 - DNA, 27 bp, Artificial Sequence
  Description of Artificial Sequence: Synthetic oligonucleotide
cctgggcttctaccctgcagagatcac

SEQ ID NO: 425528 - DNA, 28 bp, Artificial Sequence
  Description of Artificial Sequence: Synthetic oligonucleotide
ctgggcttctaccctgcagagatcacac

SEQ ID NO: 425529 - DNA, 29 bp, Artificial Sequence
  Description of Artificial Sequence: Synthetic oligonucleotide
tgggcttctaccctgcagagatcacactg

SEQ ID NO: 425530 - DNA, 28 bp, Artificial Sequence
  Description of Artificial Sequence: Synthetic oligonucleotide
gggcttctaccctgcagagatcacactg

SEQ ID NO: 425531 - DNA, 29 bp, Artificial Sequence
  Description of Artificial Sequence: Synthetic oligonucleotide
ggcttctaccctgcagagatcacactgac

SEQ ID NO: 425532 - DNA, 29 bp, Artificial Sequence
  Description of Artificial Sequence: Synthetic oligonucleotide
gcttctaccctgcagagatcacactgacc

SEQ ID NO: 425533 - DNA, 30 bp, Artificial Sequence; identical to SEQ ID NO: 3993
  Description of Artificial Sequence: Synthetic oligonucleotide

SEQ ID NO: 425534 - DNA, 30 bp, Artificial Sequence; identical to SEQ ID NO: 3994
  Description of Artificial Sequence: Synthetic oligonucleotide

SEQ ID NO: 425535 - DNA, 29 bp, Artificial Sequence
  Description of Artificial Sequence: Synthetic oligonucleotide
tctaccctgcagagatcacactgacctgg

SEQ ID NO: 425536 - DNA, 28 bp, Artificial Sequence
  Description of Artificial Sequence: Synthetic oligonucleotide
ctaccctgcagagatcacactgacctgg

SEQ ID NO: 425537 - DNA, 28 bp, Artificial Sequence
  Description of Artificial Sequence: Synthetic oligonucleotide
taccctgcagagatcacactgacctggc

SEQ ID NO: 425538 - DNA, 27 bp, Artificial Sequence
  Description of Artificial Sequence: Synthetic oligonucleotide
accctgcagagatcacactgacctggc

SEQ ID NO: 425539 - DNA, 27 bp, Artificial Sequence
  Description of Artificial Sequence: Synthetic oligonucleotide
ccctgcagagatcacactgacctggca

SEQ ID NO: 425540 - DNA, 27 bp, Artificial Sequence
  Description of Artificial Sequence: Synthetic oligonucleotide
cctgcagagatcacactgacctggcag

SEQ ID NO: 425541 - DNA, 27 bp, Artificial Sequence
  Description of Artificial Sequence: Synthetic oligonucleotide
ctgcagagatcacactgacctggcagc

SEQ ID NO: 425542 - DNA, 28 bp, Artificial Sequence
  Description of Artificial Sequence: Synthetic oligonucleotide
tgcagagatcacactgacctggcagcag

SEQ ID NO: 425543 - DNA, 27 bp, Artificial Sequence
  Description of Artificial Sequence: Synthetic oligonucleotide
gcagagatcacactgacctggcagcag

SEQ ID NO: 425544 - DNA, 27 bp, Artificial Sequence
  Description of Artificial Sequence: Synthetic oligonucleotide
cagagatcacactgacctggcagcagg

SEQ ID NO: 425545 - DNA, 29 bp, Artificial Sequence
  Description of Artificial Sequence: Synthetic oligonucleotide
agagatcacactgacctggcagcaggatg

SEQ ID NO: 425546 - DNA, 26 bp, Artificial Sequence
  Description of Artificial Sequence: Synthetic oligonucleotide
atgatgcctctgaggcggagcaccag

SEQ ID NO: 425547 - DNA, 25 bp, Artificial Sequence
  Description of Artificial Sequence: Synthetic oligonucleotide
tgatgcctctgaggcggagcaccag

SEQ ID NO: 425548 - DNA, 24 bp, Artificial Sequence
  Description of Artificial Sequence: Synthetic oligonucleotide
gatgcctctgaggcggagcaccag

SEQ ID NO: 425549 - DNA, 24 bp, Artificial Sequence
  Description of Artificial Sequence: Synthetic oligonucleotide
atgcctctgaggcggagcaccagg

SEQ ID NO: 425550 - DNA, 23 bp, Artificial Sequence
  Description of Artificial Sequence: Synthetic oligonucleotide
tgcctctgaggcggagcaccagg

SEQ ID NO: 425551 - DNA, 22 bp, Artificial Sequence
  Description of Artificial Sequence: Synthetic oligonucleotide
gcctctgaggcggagcaccagg

SEQ ID NO: 425552 - DNA, 23 bp, Artificial Sequence
  Description of Artificial Sequence: Synthetic oligonucleotide
cctctgaggcggagcaccaggga

SEQ ID NO: 425553 - DNA, 23 bp, Artificial Sequence
  Description of Artificial Sequence: Synthetic oligonucleotide
ctctgaggcggagcaccagggag

SEQ ID NO: 425554 - DNA, 23 bp, Artificial Sequence
  Description of Artificial Sequence: Synthetic oligonucleotide
tctgaggcggagcaccagggagc

SEQ ID NO: 425555 - DNA, 22 bp, Artificial Sequence
  Description of Artificial Sequence: Synthetic oligonucleotide
ctgaggcggagcaccagggagc

SEQ ID NO: 425556 - DNA, 24 bp, Artificial Sequence
  Description of Artificial Sequence: Synthetic oligonucleotide
tgaggcggagcaccagggagccta

SEQ ID NO: 425557 - DNA, 23 bp, Artificial Sequence
  Description of Artificial Sequence: Synthetic oligonucleotide
gaggcggagcaccagggagccta

SEQ ID NO: 425558 - DNA, 23 bp, Artificial Sequence
  Description of Artificial Sequence: Synthetic oligonucleotide
aggcggagcaccagggagcctac

SEQ ID NO: 425559 - DNA, 22 bp, Artificial Sequence
  Description of Artificial Sequence: Synthetic oligonucleotide
ggcggagcaccagggagcctac

SEQ ID NO: 425560 - DNA, 23 bp, Artificial Sequence
  Description of Artificial Sequence: Synthetic oligonucleotide
gcggagcaccagggagcctacct

SEQ ID NO: 425561 - DNA, 23 bp, Artificial Sequence
  Description of Artificial Sequence: Synthetic oligonucleotide
cggagcaccagggagcctacctg

SEQ ID NO: 425562 - DNA, 25 bp, Artificial Sequence
  Description of Artificial Sequence: Synthetic oligonucleotide
ggagcaccagggagcctacctggaa

SEQ ID NO: 425563 - DNA, 26 bp, Artificial Sequence
  Description of Artificial Sequence: Synthetic oligonucleotide
gagcaccagggagcctacctggaaga

SEQ ID NO: 425564 - DNA, 27 bp, Artificial Sequence
  Description of Artificial Sequence: Synthetic oligonucleotide
agcaccagggagcctacctggaagaca

SEQ ID NO: 425565 - DNA, 26 bp, Artificial Sequence
  Description of Artificial Sequence: Synthetic oligonucleotide
gcaccagggagcctacctggaagaca

SEQ ID NO: 425566 - DNA, 27 bp, Artificial Sequence
  Description of Artificial Sequence: Synthetic oligonucleotide
caccagggagcctacctggaagacaca

SEQ ID NO: 425567 - DNA, 28 bp, Artificial Sequence
  Description of Artificial Sequence: Synthetic oligonucleotide
accagggagcctacctggaagacacatg

SEQ ID NO: 425568 - DNA, 27 bp, Artificial Sequence
  Description of Artificial Sequence: Synthetic oligonucleotide
ccagggagcctacctggaagacacatg

SEQ ID NO: 425569 - DNA, 27 bp, Artificial Sequence
  Description of Artificial Sequence: Synthetic oligonucleotide
cagggagcctacctggaagacacatgc

SEQ ID NO: 425570 - DNA, 27 bp, Artificial Sequence
  Description of Artificial Sequence: Synthetic oligonucleotide
agggagcctacctggaagacacatgcg

SEQ ID NO: 425571 - DNA, 27 bp, Artificial Sequence
  Description of Artificial Sequence: Synthetic oligonucleotide
gggagcctacctggaagacacatgcgt

SEQ ID NO: 425572 - DNA, 27 bp, Artificial Sequence
  Description of Artificial Sequence: Synthetic oligonucleotide
ggagcctacctggaagacacatgcgtg

SEQ ID NO: 425573 - DNA, 23 bp, Artificial Sequence
  Description of Artificial Sequence: Synthetic oligonucleotide
gggagggggagggcaaagtccca

SEQ ID NO: 425574 - DNA, 23 bp, Artificial Sequence
  Description of Artificial Sequence: Synthetic oligonucleotide
ggagggggagggcaaagtcccag

SEQ ID NO: 425575 - DNA, 23 bp, Artificial Sequence
  Description of Artificial Sequence: Synthetic oligonucleotide
gagggggagggcaaagtcccagg

SEQ ID NO: 425576 - DNA, 23 bp, Artificial Sequence
  Description of Artificial Sequence: Synthetic oligonucleotide
agggggagggcaaagtcccaggg

SEQ ID NO: 425577 - DNA, 22 bp, Artificial Sequence
  Description of Artificial Sequence: Synthetic oligonucleotide
gggggagggcaaagtcccaggg

SEQ ID NO: 425578 - DNA, 22 bp, Artificial Sequence
  Description of Artificial Sequence: Synthetic oligonucleotide
ggggagggcaaagtcccagggc

SEQ ID NO: 425579 - DNA, 22 bp, Artificial Sequence
  Description of Artificial Sequence: Synthetic oligonucleotide
gggagggcaaagtcccagggcc

SEQ ID NO: 425580 - DNA, 22 bp, Artificial Sequence
  Description of Artificial Sequence: Synthetic oligonucleotide
ggagggcaaagtcccagggccc

SEQ ID NO: 425581 - DNA, 23 bp, Artificial Sequence
  Description of Artificial Sequence: Synthetic oligonucleotide
gagggcaaagtcccagggcccca

SEQ ID NO: 425582 - DNA, 23 bp, Artificial Sequence
  Description of Artificial Sequence: Synthetic oligonucleotide
agggcaaagtcccagggccccag

SEQ ID NO: 425583 - DNA, 22 bp, Artificial Sequence
  Description of Artificial Sequence: Synthetic oligonucleotide
gggcaaagtcccagggccccag

SEQ ID NO: 425584 - DNA, 23 bp, Artificial Sequence
  Description of Artificial Sequence: Synthetic oligonucleotide
ggcaaagtcccagggccccagga

SEQ ID NO: 425585 - DNA, 24 bp, Artificial Sequence
  Description of Artificial Sequence: Synthetic oligonucleotide
gcaaagtcccagggccccaggagt

SEQ ID NO: 425586 - DNA, 24 bp, Artificial Sequence
  Description of Artificial Sequence: Synthetic oligonucleotide
caaagtcccagggccccaggagtg

SEQ ID NO: 425587 - DNA, 24 bp, Artificial Sequence
  Description of Artificial Sequence: Synthetic oligonucleotide
aaagtcccagggccccaggagtgg

SEQ ID NO: 425588 - DNA, 23 bp, Artificial Sequence
  Description of Artificial Sequence: Synthetic oligonucleotide
aagtcccagggccccaggagtgg

SEQ ID NO: 425589 - DNA, 22 bp, Artificial Sequence
  Description of Artificial Sequence: Synthetic oligonucleotide
agtcccagggccccaggagtgg

SEQ ID NO: 425590 - DNA, 21 bp, Artificial Sequence
  Description of Artificial Sequence: Synthetic oligonucleotide
gtcccagggccccaggagtgg

SEQ ID NO: 425591 - DNA, 22 bp, Artificial Sequence
  Description of Artificial Sequence: Synthetic oligonucleotide
tcccagggccccaggagtggct

SEQ ID NO: 425592 - DNA, 21 bp, Artificial Sequence
  Description of Artificial Sequence: Synthetic oligonucleotide
cccagggccccaggagtggct

SEQ ID NO: 425593 - DNA, 22 bp, Artificial Sequence
  Description of Artificial Sequence: Synthetic oligonucleotide
ccagggccccaggagtggctct

SEQ ID NO: 425594 - DNA, 24 bp, Artificial Sequence
  Description of Artificial Sequence: Synthetic oligonucleotide
cagggccccaggagtggctctcaa

SEQ ID NO: 425595 - DNA, 24 bp, Artificial Sequence
  Description of Artificial Sequence: Synthetic oligonucleotide
agggccccaggagtggctctcaag

SEQ ID NO: 425596 - DNA, 23 bp, Artificial Sequence
  Description of Artificial Sequence: Synthetic oligonucleotide
gggccccaggagtggctctcaag

SEQ ID NO: 425597 - DNA, 23 bp, Artificial Sequence
  Description of Artificial Sequence: Synthetic oligonucleotide
ggccccaggagtggctctcaagg

SEQ ID NO: 425598 - DNA, 23 bp, Artificial Sequence
  Description of Artificial Sequence: Synthetic oligonucleotide
gccccaggagtggctctcaaggg

SEQ ID NO: 425599 - DNA, 24 bp, Artificial Sequence
  Description of Artificial Sequence: Synthetic oligonucleotide
ccccaggagtggctctcaagggct

SEQ ID NO: 425600 - DNA, 25 bp, Artificial Sequence
  Description of Artificial Sequence: Synthetic oligonucleotide
cccaggagtggctctcaagggctca

SEQ ID NO: 425601 - DNA, 25 bp, Artificial Sequence
  Description of Artificial Sequence: Synthetic oligonucleotide
ccaggagtggctctcaagggctcag

SEQ ID NO: 425602 - DNA, 25 bp, Artificial Sequence
  Description of Artificial Sequence: Synthetic oligonucleotide
caggagtggctctcaagggctcagg

SEQ ID NO: 425603 - DNA, 25 bp, Artificial Sequence
  Description of Artificial Sequence: Synthetic oligonucleotide
aggagtggctctcaagggctcaggc

SEQ ID NO: 425604 - DNA, 24 bp, Artificial Sequence
  Description of Artificial Sequence: Synthetic oligonucleotide
ggagtggctctcaagggctcaggc

SEQ ID NO: 425605 - DNA, 24 bp, Artificial Sequence
  Description of Artificial Sequence: Synthetic oligonucleotide
gagtggctctcaagggctcaggcc

SEQ ID NO: 425606 - DNA, 24 bp, Artificial Sequence
  Description of Artificial Sequence: Synthetic oligonucleotide
agtggctctcaagggctcaggccc

SEQ ID NO: 425607 - DNA, 23 bp, Artificial Sequence
  Description of Artificial Sequence: Synthetic oligonucleotide
gtggctctcaagggctcaggccc

SEQ ID NO: 425608 - DNA, 23 bp, Artificial Sequence
  Description of Artificial Sequence: Synthetic oligonucleotide
tggctctcaagggctcaggcccc

SEQ ID NO: 425609 - DNA, 22 bp, Artificial Sequence
  Description of Artificial Sequence: Synthetic oligonucleotide
ggctctcaagggctcaggcccc

SEQ ID NO: 425610 - DNA, 23 bp, Artificial Sequence
  Description of Artificial Sequence: Synthetic oligonucleotide
gctctcaagggctcaggccccga

SEQ ID NO: 425611 - DNA, 23 bp, Artificial Sequence
  Description of Artificial Sequence: Synthetic oligonucleotide
ctctcaagggctcaggccccgag

SEQ ID NO: 425612 - DNA, 23 bp, Artificial Sequence
  Description of Artificial Sequence: Synthetic oligonucleotide
tctcaagggctcaggccccgagg

SEQ ID NO: 425613 - DNA, 22 bp, Artificial Sequence
  Description of Artificial Sequence: Synthetic oligonucleotide
ctcaagggctcaggccccgagg

SEQ ID NO: 425614 - DNA, 22 bp, Artificial Sequence
  Description of Artificial Sequence: Synthetic oligonucleotide
tcaagggctcaggccccgaggc

SEQ ID NO: 425615 - DNA, 21 bp, Artificial Sequence
  Description of Artificial Sequence: Synthetic oligonucleotide
caagggctcaggccccgaggc

SEQ ID NO: 425616 - DNA, 21 bp, Artificial Sequence
  Description of Artificial Sequence: Synthetic oligonucleotide
aagggctcaggccccgaggcg

SEQ ID NO: 425617 - DNA, 20 bp, Artificial Sequence
  Description of Artificial Sequence: Synthetic oligonucleotide
agggctcaggccccgaggcg

SEQ ID NO: 425618 - DNA, 20 bp, Artificial Sequence
  Description of Artificial Sequence: Synthetic oligonucleotide
gggctcaggccccgaggcgt

SEQ ID NO: 425619 - DNA, 20 bp, Artificial Sequence
  Description of Artificial Sequence: Synthetic oligonucleotide
ggctcaggccccgaggcggt

SEQ ID NO: 425620 - DNA, 21 bp, Artificial Sequence
  Description of Artificial Sequence: Synthetic oligonucleotide
gctcaggccccgaggcggtgt

SEQ ID NO: 425621 - DNA, 22 bp, Artificial Sequence
  Description of Artificial Sequence: Synthetic oligonucleotide
ctcaggccccgaggcggtgtct

SEQ ID NO: 425622 - DNA, 22 bp, Artificial Sequence
  Description of Artificial Sequence: Synthetic oligonucleotide
tcaggccccgaggcggtgtctg

SEQ ID NO: 425623 - DNA, 21 bp, Artificial Sequence
  Description of Artificial Sequence: Synthetic oligonucleotide
caggccccgaggcggtgtctg

SEQ ID NO: 425624 - DNA, 21 bp, Artificial Sequence
  Description of Artificial Sequence: Synthetic oligonucleotide
aggccccgaggcggtgtctgg

SEQ ID NO: 425625 - DNA, 20 bp, Artificial Sequence
  Description of Artificial Sequence: Synthetic oligonucleotide
ggccccgaggcggtgtctgg

SEQ ID NO: 425626 - DNA, 20 bp, Artificial Sequence
  Description of Artificial Sequence: Synthetic oligonucleotide
gccccgaggcggtgtctggg

SEQ ID NO: 425627 - DNA, 22 bp, Artificial Sequence
  Description of Artificial Sequence: Synthetic oligonucleotide
ccccgaggcggtgtctggggtt

SEQ ID NO: 425628 - DNA, 22 bp, Artificial Sequence
  Description of Artificial Sequence: Synthetic oligonucleotide
cccgaggcggtgtctggggttg

SEQ ID NO: 425629 - DNA, 24 bp, Artificial Sequence
  Description of Artificial Sequence: Synthetic oligonucleotide
ccgaggcggtgtctggggttggaa

SEQ ID NO: 425630 - DNA, 24 bp, Artificial Sequence
  Description of Artificial Sequence: Synthetic oligonucleotide
cgaggcggtgtctggggttggaag

SEQ ID NO: 425631 - DNA, 24 bp, Artificial Sequence
  Description of Artificial Sequence: Synthetic oligonucleotide
gaggcggtgtctggggttggaagg

SEQ ID NO: 425632 - DNA, 25 bp, Artificial Sequence
  Description of Artificial Sequence: Synthetic oligonucleotide
aggcggtgtctggggttggaaggct

SEQ ID NO: 425633 - DNA, 24 bp, Artificial Sequence
  Description of Artificial Sequence: Synthetic oligonucleotide
ggcggtgtctggggttggaaggct

SEQ ID NO: 425634 - DNA, 25 bp, Artificial Sequence
  Description of Artificial Sequence: Synthetic oligonucleotide
gcggtgtctggggttggaaggctca

SEQ ID NO: 425635 - DNA, 27 bp, Artificial Sequence
  Description of Artificial Sequence: Synthetic oligonucleotide
cggtgtctggggttggaaggctcagta

SEQ ID NO: 425636 - DNA, 29 bp, Artificial Sequence
  Description of Artificial Sequence: Synthetic oligonucleotide
ggtgtctggggttggaaggctcagtattg

SEQ ID NO: 425637 - DNA, 30 bp, Artificial Sequence
  Description of Artificial Sequence: Synthetic oligonucleotide
gtgtctggggttggaaggctcagtattgag

SEQ ID NO: 425638 - DNA, 34 bp, Artificial Sequence
  Description of Artificial Sequence: Synthetic oligonucleotide
tgtctggggttggaaggctcagtattgagaattc

SEQ ID NO: 425639 - DNA, 33 bp, Artificial Sequence
  Description of Artificial Sequence: Synthetic oligonucleotide
gtctggggttggaaggctcagtattgagaattc

SEQ ID NO: 425640 - DNA, 33 bp, Artificial Sequence
  Description of Artificial Sequence: Synthetic oligonucleotide
tctggggttggaaggctcagtattgagaattcc

SEQ ID NO: 425641 - DNA, 32 bp, Artificial Sequence
  Description of Artificial Sequence: Synthetic oligonucleotide
ctggggttggaaggctcagtattgagaattcc

SEQ ID NO: 425642 - DNA, 32 bp, Artificial Sequence
  Description of Artificial Sequence: Synthetic oligonucleotide
tggggttggaaggctcagtattgagaattccc

SEQ ID NO: 425643 - DNA, 31 bp, Artificial Sequence
  Description of Artificial Sequence: Synthetic oligonucleotide
ggggttggaaggctcagtattgagaattccc

SEQ ID NO: 425644 - DNA, 31 bp, Artificial Sequence
  Description of Artificial Sequence: Synthetic oligonucleotide
gggttggaaggctcagtattgagaattcccc

SEQ ID NO: 425645 - DNA, 33 bp, Artificial Sequence
  Description of Artificial Sequence: Synthetic oligonucleotide
ggttggaaggctcagtattgagaattccccatc

SEQ ID NO: 425646 - DNA, 34 bp, Artificial Sequence
  Description of Artificial Sequence: Synthetic oligonucleotide
gttggaaggctcagtattgagaattccccatctc

SEQ ID NO: 425647 - DNA, 34 bp, Artificial Sequence
  Description of Artificial Sequence: Synthetic oligonucleotide
ttggaaggctcagtattgagaattccccatctcc

SEQ ID NO: 425648 - DNA, 33 bp, Artificial Sequence
  Description of Artificial Sequence: Synthetic oligonucleotide
tggaaggctcagtattgagaattccccatctcc

SEQ ID NO: 425649 - DNA, 32 bp, Artificial Sequence
  Description of Artificial Sequence: Synthetic oligonucleotide
ggaaggctcagtattgagaattccccatctcc

SEQ ID NO: 425650 - DNA, 32 bp, Artificial Sequence
  Description of Artificial Sequence: Synthetic oligonucleotide
gaaggctcagtattgagaattccccatctccc

SEQ ID NO: 425651 - DNA, 32 bp, Artificial Sequence
  Description of Artificial Sequence: Synthetic oligonucleotide
aaggctcagtattgagaattccccatctcccc

SEQ ID NO: 425652 - DNA, 31 bp, Artificial Sequence
  Description of Artificial Sequence: Synthetic oligonucleotide
aggctcagtattgagaattccccatctcccc

SEQ ID NO: 425653 - DNA, 30 bp, Artificial Sequence
  Description of Artificial Sequence: Synthetic oligonucleotide
ggctcagtattgagaattccccatctcccc

SEQ ID NO: 425654 - DNA, 31 bp, Artificial Sequence
  Description of Artificial Sequence: Synthetic oligonucleotide
gctcagtattgagaattccccatctccccag

SEQ ID NO: 425655 - DNA, 32 bp, Artificial Sequence
  Description of Artificial Sequence: Synthetic oligonucleotide
ctcagtattgagaattccccatctccccagag

SEQ ID NO: 425656 - DNA, 35 bp, Artificial Sequence
  Description of Artificial Sequence: Synthetic oligonucleotide
tcagtattgagaattccccatctccccagagtttc

SEQ ID NO: 425657 - DNA, 34 bp, Artificial Sequence
  Description of Artificial Sequence: Synthetic oligonucleotide
cagtattgagaattccccatctccccagagtttc

SEQ ID NO: 425658 - DNA, 35 bp, Artificial Sequence
  Description of Artificial Sequence: Synthetic oligonucleotide
agtattgagaattccccatctccccagagtttctc

SEQ ID NO: 425659 - DNA, 34 bp, Artificial Sequence
  Description of Artificial Sequence: Synthetic oligonucleotide
gtattgagaattccccatctccccagagtttctc

SEQ ID NO: 425660 - DNA, 37 bp, Artificial Sequence
  Description of Artificial Sequence: Synthetic oligonucleotide
tattgagaattccccatctccccagagtttctctttc

SEQ ID NO: 425661 - DNA, 36 bp, Artificial Sequence
  Description of Artificial Sequence: Synthetic oligonucleotide
attgagaattccccatctccccagagtttctctttc

SEQ ID NO: 425662 - DNA, 35 bp, Artificial Sequence
  Description of Artificial Sequence: Synthetic oligonucleotide
ttgagaattccccatctccccagagtttctctttc

SEQ ID NO: 425663 - DNA, 34 bp, Artificial Sequence
  Description of Artificial Sequence: Synthetic oligonucleotide
tgagaattccccatctccccagagtttctctttc

SEQ ID NO: 425664 - DNA, 33 bp, Artificial Sequence
  Description of Artificial Sequence: Synthetic oligonucleotide
gagaattccccatctccccagagtttctctttc

SEQ ID NO: 425665 - DNA, 34 bp, Artificial Sequence
  Description of Artificial Sequence: Synthetic oligonucleotide
agaattccccatctccccagagtttctctttctc

SEQ ID NO: 425666 - DNA, 33 bp, Artificial Sequence
  Description of Artificial Sequence: Synthetic oligonucleotide
gaattccccatctccccagagtttctctttctc

SEQ ID NO: 425667 - DNA, 34 bp, Artificial Sequence
  Description of Artificial Sequence: Synthetic oligonucleotide
aattccccatctccccagagtttctctttctctc

SEQ ID NO: 425668 - DNA, 33 bp, Artificial Sequence
  Description of Artificial Sequence: Synthetic oligonucleotide
attccccatctccccagagtttctctttctctc

SEQ ID NO: 425669 - DNA, 32 bp, Artificial Sequence
  Description of Artificial Sequence: Synthetic oligonucleotide
ttccccatctccccagagtttctctttctctc

SEQ ID NO: 425670 - DNA, 31 bp, Artificial Sequence
  Description of Artificial Sequence: Synthetic oligonucleotide
tccccatctccccagagtttctctttctctc

SEQ ID NO: 425671 - DNA, 30 bp, Artificial Sequence
  Description of Artificial Sequence: Synthetic oligonucleotide
ccccatctccccagagtttctctttctctc

SEQ ID NO: 425672 - DNA, 30 bp, Artificial Sequence
  Description of Artificial Sequence: Synthetic oligonucleotide
cccatctccccagagtttctctttctctcc

SEQ ID NO: 425673 - DNA, 30 bp, Artificial Sequence
  Description of Artificial Sequence: Synthetic oligonucleotide
ccatctccccagagtttctctttctctccc

SEQ ID NO: 425674 - DNA, 32 bp, Artificial Sequence
  Description of Artificial Sequence: Synthetic oligonucleotide
catctccccagagtttctctttctctcccaac

SEQ ID NO: 425675 - DNA, 32 bp, Artificial Sequence
  Description of Artificial Sequence: Synthetic oligonucleotide
atctccccagagtttctctttctctcccaacc

SEQ ID NO: 425676 - DNA, 31 bp, Artificial Sequence
  Description of Artificial Sequence: Synthetic oligonucleotide
tctccccagagtttctctttctctcccaacc

SEQ ID NO: 425677 - DNA, 30 bp, Artificial Sequence
  Description of Artificial Sequence: Synthetic oligonucleotide
ctccccagagtttctctttctctcccaacc

SEQ ID NO: 425678 - DNA, 30 bp, Artificial Sequence
  Description of Artificial Sequence: Synthetic oligonucleotide
tccccagagtttctctttctctcccaaccc

SEQ ID NO: 425679 - DNA, 29 bp, Artificial Sequence
  Description of Artificial Sequence: Synthetic oligonucleotide
ccccagagtttctctttctctcccaaccc

SEQ ID NO: 425680 - DNA, 29 bp, Artificial Sequence
  Description of Artificial Sequence: Synthetic oligonucleotide
cccagagtttctctttctctcccaacccg

SEQ ID NO: 425681 - DNA, 30 bp, Artificial Sequence
  Description of Artificial Sequence: Synthetic oligonucleotide
ccagagtttctctttctctcccaacccgtg

SEQ ID NO: 425682 - DNA, 31 bp, Artificial Sequence
  Description of Artificial Sequence: Synthetic oligonucleotide
cagagtttctctttctctcccaacccgtgtc

SEQ ID NO: 425683 - DNA, 32 bp, Artificial Sequence
  Description of Artificial Sequence: Synthetic oligonucleotide
agagtttctctttctctcccaacccgtgtcag

SEQ ID NO: 425684 - DNA, 31 bp, Artificial Sequence
  Description of Artificial Sequence: Synthetic oligonucleotide
gagtttctctttctctcccaacccgtgtcag

SEQ ID NO: 425685 - DNA, 31 bp, Artificial Sequence
  Description of Artificial Sequence: Synthetic oligonucleotide
agtttctctttctctcccaacccgtgtcagg

SEQ ID NO: 425686 - DNA, 30 bp, Artificial Sequence
  Description of Artificial Sequence: Synthetic oligonucleotide
gtttctctttctctcccaacccgtgtcagg

SEQ ID NO: 425687 - DNA, 31 bp, Artificial Sequence
  Description of Artificial Sequence: Synthetic oligonucleotide
tttctctttctctcccaacccgtgtcaggtc

SEQ ID NO: 425688 - DNA, 30 bp, Artificial Sequence
  Description of Artificial Sequence: Synthetic oligonucleotide
ttctctttctctcccaacccgtgtcaggtc

SEQ ID NO: 425689 - DNA, 29 bp, Artificial Sequence
  Description of Artificial Sequence: Synthetic oligonucleotide
tctctttctctcccaacccgtgtcaggtc

SEQ ID NO: 425690 - DNA, 28 bp, Artificial Sequence
  Description of Artificial Sequence: Synthetic oligonucleotide
ctctttctctcccaacccgtgtcaggtc

SEQ ID NO: 425691 - DNA, 28 bp, Artificial Sequence
  Description of Artificial Sequence: Synthetic oligonucleotide
tctttctctcccaacccgtgtcaggtcc

SEQ ID NO: 425692 - DNA, 27 bp, Artificial Sequence
  Description of Artificial Sequence: Synthetic oligonucleotide
ctttctctcccaacccgtgtcaggtcc

SEQ ID NO: 425693 - DNA, 29 bp, Artificial Sequence
  Description of Artificial Sequence: Synthetic oligonucleotide
tttctctcccaacccgtgtcaggtccttc

SEQ ID NO: 425694 - DNA, 28 bp, Artificial Sequence
  Description of Artificial Sequence: Synthetic oligonucleotide
ttctctcccaacccgtgtcaggtccttc

SEQ ID NO: 425695 - DNA, 27 bp, Artificial Sequence
  Description of Artificial Sequence: Synthetic oligonucleotide
tctctcccaacccgtgtcaggtccttc

SEQ ID NO: 425696 - DNA, 27 bp, Artificial Sequence
  Description of Artificial Sequence: Synthetic oligonucleotide
ctctcccaacccgtgtcaggtccttca

SEQ ID NO: 425697 - DNA, 28 bp, Artificial Sequence
  Description of Artificial Sequence: Synthetic oligonucleotide
tctcccaacccgtgtcaggtccttcatc

SEQ ID NO: 425698 - DNA, 27 bp, Artificial Sequence
  Description of Artificial Sequence: Synthetic oligonucleotide
ctcccaacccgtgtcaggtccttcatc

SEQ ID NO: 425699 - DNA, 27 bp, Artificial Sequence
  Description of Artificial Sequence: Synthetic oligonucleotide
tcccaacccgtgtcaggtccttcatcc

SEQ ID NO: 425700 - DNA, 27 bp, Artificial Sequence
  Description of Artificial Sequence: Synthetic oligonucleotide
cccaacccgtgtcaggtccttcatcct

SEQ ID NO: 425701 - DNA, 27 bp, Artificial Sequence
  Description of Artificial Sequence: Synthetic oligonucleotide
ccaacccgtgtcaggtccttcatcctg

SEQ ID NO: 425702 - DNA, 27 bp, Artificial Sequence
  Description of Artificial Sequence: Synthetic oligonucleotide
caacccgtgtcaggtccttcatcctgg

SEQ ID NO: 425703 - DNA, 30 bp, Artificial Sequence
  Description of Artificial Sequence: Synthetic oligonucleotide
aacccgtgtcaggtccttcatcctggatac

SEQ ID NO: 425704 - DNA, 29 bp, Artificial Sequence
  Description of Artificial Sequence: Synthetic oligonucleotide
acccgtgtcaggtccttcatcctggatac

SEQ ID NO: 425705 - DNA, 28 bp, Artificial Sequence
  Description of Artificial Sequence: Synthetic oligonucleotide
cccgtgtcaggtccttcatcctggatac

SEQ ID NO: 425706 - DNA, 29 bp, Artificial Sequence
  Description of Artificial Sequence: Synthetic oligonucleotide
ccgtgtcaggtccttcatcctggatactc

SEQ ID NO: 425707 - DNA, 33 bp, Artificial Sequence
  Description of Artificial Sequence: Synthetic oligonucleotide
cgtgtcaggtccttcatcctggatactcataac

SEQ ID NO: 425708 - DNA, 33 bp, Artificial Sequence
  Description of Artificial Sequence: Synthetic oligonucleotide
gtgtcaggtccttcatcctggatactcataacg

SEQ ID NO: 425709 - DNA, 33 bp, Artificial Sequence
  Description of Artificial Sequence: Synthetic oligonucleotide
tgtcaggtccttcatcctggatactcataacgc

SEQ ID NO: 425710 - DNA, 32 bp, Artificial Sequence
  Description of Artificial Sequence: Synthetic oligonucleotide
gtcaggtccttcatcctggatactcataacgc

SEQ ID NO: 425711 - DNA, 32 bp, Artificial Sequence
  Description of Artificial Sequence: Synthetic oligonucleotide
tcaggtccttcatcctggatactcataacgcg

SEQ ID NO: 425712 - DNA, 31 bp, Artificial Sequence
  Description of Artificial Sequence: Synthetic oligonucleotide
caggtccttcatcctggatactcataacgcg

SEQ ID NO: 425713 - DNA, 31 bp, Artificial Sequence
  Description of Artificial Sequence: Synthetic oligonucleotide
aggtccttcatcctggatactcataacgcgg

SEQ ID NO: 425714 - DNA, 30 bp, Artificial Sequence
  Description of Artificial Sequence: Synthetic oligonucleotide
ggtccttcatcctggatactcataacgcgg

SEQ ID NO: 425715 - DNA, 30 bp, Artificial Sequence
  Description of Artificial Sequence: Synthetic oligonucleotide
gtccttcatcctggatactcataacgcggc

SEQ ID NO: 425716 - DNA, 30 bp, Artificial Sequence
  Description of Artificial Sequence: Synthetic oligonucleotide
tccttcatcctggatactcataacgcggcc

SEQ ID NO: 425717 - DNA, 29 bp, Artificial Sequence
  Description of Artificial Sequence: Synthetic oligonucleotide
ccttcatcctggatactcataacgcggcc

SEQ ID NO: 425718 - DNA, 29 bp, Artificial Sequence
  Description of Artificial Sequence: Synthetic oligonucleotide
cttcatcctggatactcataacgcggccc

SEQ ID NO: 425719 - DNA, 29 bp, Artificial Sequence
  Description of Artificial Sequence: Synthetic oligonucleotide
ttcatcctggatactcataacgcggcccc

SEQ ID NO: 425720 - DNA, 28 bp, Artificial Sequence
  Description of Artificial Sequence: Synthetic oligonucleotide
tcatcctggatactcataacgcggcccc

SEQ ID NO: 425721 - DNA, 27 bp, Artificial Sequence
  Description of Artificial Sequence: Synthetic oligonucleotide
catcctggatactcataacgcggcccc

SEQ ID NO: 425722 - DNA, 31 bp, Artificial Sequence
  Description of Artificial Sequence: Synthetic oligonucleotide
atcctggatactcataacgcggccccatttc

SEQ ID NO: 425723 - DNA, 30 bp, Artificial Sequence
  Description of Artificial Sequence: Synthetic oligonucleotide
tcctggatactcataacgcggccccatttc

SEQ ID NO: 425724 - DNA, 29 bp, Artificial Sequence
  Description of Artificial Sequence: Synthetic oligonucleotide
cctggatactcataacgcggccccatttc

SEQ ID NO: 425725 - DNA, 30 bp, Artificial Sequence
  Description of Artificial Sequence: Synthetic oligonucleotide
ctggatactcataacgcggccccatttctc

SEQ ID NO: 425726 - DNA, 31 bp, Artificial Sequence
  Description of Artificial Sequence: Synthetic oligonucleotide
tggatactcataacgcggccccatttctcac

SEQ ID NO: 425727 - DNA, 30 bp, Artificial Sequence
  Description of Artificial Sequence: Synthetic oligonucleotide
ggatactcataacgcggccccatttctcac

SEQ ID NO: 425728 - DNA, 31 bp, Artificial Sequence
  Description of Artificial Sequence: Synthetic oligonucleotide
gatactcataacgcggccccatttctcactc

SEQ ID NO: 425729 - DNA, 31 bp, Artificial Sequence
  Description of Artificial Sequence: Synthetic oligonucleotide
atactcataacgcggccccatttctcactcc

SEQ ID NO: 425730 - DNA, 30 bp, Artificial Sequence
  Description of Artificial Sequence: Synthetic oligonucleotide
tactcataacgcggccccatttctcactcc

SEQ ID NO: 425731 - DNA, 29 bp, Artificial Sequence
  Description of Artificial Sequence: Synthetic oligonucleotide
actcataacgcggccccatttctcactcc

SEQ ID NO: 425732 - DNA, 28 bp, Artificial Sequence
  Description of Artificial Sequence: Synthetic oligonucleotide
ctcataacgcggccccatttctcactcc

SEQ ID NO: 425733 - DNA, 28 bp, Artificial Sequence
  Description of Artificial Sequence: Synthetic oligonucleotide
tcataacgcggccccatttctcactccc

SEQ ID NO: 425734 - DNA, 27 bp, Artificial Sequence
  Description of Artificial Sequence: Synthetic oligonucleotide
cataacgcggccccatttctcactccc

SEQ ID NO: 425735 - DNA, 30 bp, Artificial Sequence
  Description of Artificial Sequence: Synthetic oligonucleotide
ataacgcggccccatttctcactcccattg

SEQ ID NO: 425736 - DNA, 29 bp, Artificial Sequence
  Description of Artificial Sequence: Synthetic oligonucleotide
taacgcggccccatttctcactcccattg

SEQ ID NO: 425737 - DNA, 28 bp, Artificial Sequence
  Description of Artificial Sequence: Synthetic oligonucleotide
aacgcggccccatttctcactcccattg

SEQ ID NO: 425738 - DNA, 27 bp, Artificial Sequence
  Description of Artificial Sequence: Synthetic oligonucleotide
acgcggccccatttctcactcccattg

SEQ ID NO: 425739 - DNA, 26 bp, Artificial Sequence
  Description of Artificial Sequence: Synthetic oligonucleotide
cgcggccccatttctcactcccattg

SEQ ID NO: 425740 - DNA, 26 bp, Artificial Sequence
  Description of Artificial Sequence: Synthetic oligonucleotide
gcggccccatttctcactcccattgg

SEQ ID NO: 425741 - DNA, 26 bp, Artificial Sequence
  Description of Artificial Sequence: Synthetic oligonucleotide
cggccccatttctcactcccattggg

SEQ ID NO: 425742 - DNA, 26 bp, Artificial Sequence
  Description of Artificial Sequence: Synthetic oligonucleotide
ggccccatttctcactcccattgggc

SEQ ID NO: 425743 - DNA, 27 bp, Artificial Sequence
  Description of Artificial Sequence: Synthetic oligonucleotide
gccccatttctcactcccattgggcgt

SEQ ID NO: 425744 - DNA, 27 bp, Artificial Sequence
  Description of Artificial Sequence: Synthetic oligonucleotide
ccccatttctcactcccattgggcgtc

SEQ ID NO: 425745 - DNA, 27 bp, Artificial Sequence
  Description of Artificial Sequence: Synthetic oligonucleotide
cccatttctcactcccattgggcgtcg

SEQ ID NO: 425746 - DNA, 27 bp, Artificial Sequence
  Description of Artificial Sequence: Synthetic oligonucleotide
ccatttctcactcccattgggcgtcgc

SEQ ID NO: 425747 - DNA, 27 bp, Artificial Sequence
  Description of Artificial Sequence: Synthetic oligonucleotide
catttctcactcccattgggcgtcgcg

SEQ ID NO: 425748 - DNA, 30 bp, Artificial Sequence
  Description of Artificial Sequence: Synthetic oligonucleotide
atttctcactcccattgggcgtcgcgtttc

SEQ ID NO: 425749 - DNA, 29 bp, Artificial Sequence
  Description of Artificial Sequence: Synthetic oligonucleotide
tttctcactcccattgggcgtcgcgtttc

SEQ ID NO: 425750 - DNA, 28 bp, Artificial Sequence
  Description of Artificial Sequence: Synthetic oligonucleotide
ttctcactcccattgggcgtcgcgtttc

SEQ ID NO: 425751 - DNA, 27 bp, Artificial Sequence
  Description of Artificial Sequence: Synthetic oligonucleotide
tctcactcccattgggcgtcgcgtttc

SEQ ID NO: 425752 - DNA, 27 bp, Artificial Sequence
  Description of Artificial Sequence: Synthetic oligonucleotide
ctcactcccattgggcgtcgcgtttct

SEQ ID NO: 425753 - DNA, 28 bp, Artificial Sequence
  Description of Artificial Sequence: Synthetic oligonucleotide
tcactcccattgggcgtcgcgtttctag

SEQ ID NO: 425754 - DNA, 27 bp, Artificial Sequence
  Description of Artificial Sequence: Synthetic oligonucleotide
cactcccattgggcgtcgcgtttctag

SEQ ID NO: 425755 - DNA, 28 bp, Artificial Sequence
  Description of Artificial Sequence: Synthetic oligonucleotide
actcccattgggcgtcgcgtttctagag

SEQ ID NO: 425756 - DNA, 27 bp, Artificial Sequence
  Description of Artificial Sequence: Synthetic oligonucleotide
ctcccattgggcgtcgcgtttctagag

SEQ ID NO: 425757 - DNA, 29 bp, Artificial Sequence
  Description of Artificial Sequence: Synthetic oligonucleotide
tcccattgggcgtcgcgtttctagagaag

SEQ ID NO: 425758 - DNA, 28 bp, Artificial Sequence
  Description of Artificial Sequence: Synthetic oligonucleotide
cccattgggcgtcgcgtttctagagaag

SEQ ID NO: 425759 - DNA, 28 bp, Artificial Sequence
  Description of Artificial Sequence: Synthetic oligonucleotide
ccattgggcgtcgcgtttctagagaagc

SEQ ID NO: 425760 - DNA, 28 bp, Artificial Sequence
  Description of Artificial Sequence: Synthetic oligonucleotide
cattgggcgtcgcgtttctagagaagcc

SEQ ID NO: 425761 - DNA, 31 bp, Artificial Sequence
  Description of Artificial Sequence: Synthetic oligonucleotide
attgggcgtcgcgtttctagagaagccaatc

SEQ ID NO: 425762 - DNA, 30 bp, Artificial Sequence
  Description of Artificial Sequence: Synthetic oligonucleotide
ttgggcgtcgcgtttctagagaagccaatc

SEQ ID NO: 425763 - DNA, 29 bp, Artificial Sequence
  Description of Artificial Sequence: Synthetic oligonucleotide
tgggcgtcgcgtttctagagaagccaatc

SEQ ID NO: 425764 - DNA, 28 bp, Artificial Sequence
  Description of Artificial Sequence: Synthetic oligonucleotide
gggcgtcgcgtttctagagaagccaatc

SEQ ID NO: 425765 - DNA, 29 bp, Artificial Sequence
  Description of Artificial Sequence: Synthetic oligonucleotide
ggcgtcgcgtttctagagaagccaatcag

SEQ ID NO: 425766 - DNA, 30 bp, Artificial Sequence
  Description of Artificial Sequence: Synthetic oligonucleotide
gcgtcgcgtttctagagaagccaatcagtg

SEQ ID NO: 425767 - DNA, 31 bp, Artificial Sequence
  Description of Artificial Sequence: Synthetic oligonucleotide
cgtcgcgtttctagagaagccaatcagtgtc

SEQ ID NO: 425768 - DNA, 31 bp, Artificial Sequence
  Description of Artificial Sequence: Synthetic oligonucleotide
gtcgcgtttctagagaagccaatcagtgtcg

SEQ ID NO: 425769 - DNA, 31 bp, Artificial Sequence
  Description of Artificial Sequence: Synthetic oligonucleotide
tcgcgtttctagagaagccaatcagtgtcgc

SEQ ID NO: 425770 - DNA, 30 bp, Artificial Sequence
  Description of Artificial Sequence: Synthetic oligonucleotide
cgcgtttctagagaagccaatcagtgtcgc

SEQ ID NO: 425771 - DNA, 30 bp, Artificial Sequence
  Description of Artificial Sequence: Synthetic oligonucleotide
gcgtttctagagaagccaatcagtgtcgcc

SEQ ID NO: 425772 - DNA, 30 bp, Artificial Sequence
  Description of Artificial Sequence: Synthetic oligonucleotide
cgtttctagagaagccaatcagtgtcgccg

SEQ ID NO: 425773 - DNA, 30 bp, Artificial Sequence
  Description of Artificial Sequence: Synthetic oligonucleotide
gtttctagagaagccaatcagtgtcgccgc

SEQ ID NO: 425774 - DNA, 31 bp, Artificial Sequence
  Description of Artificial Sequence: Synthetic oligonucleotide
tttctagagaagccaatcagtgtcgccgcag

SEQ ID NO: 425775 - DNA, 30 bp, Artificial Sequence
  Description of Artificial Sequence: Synthetic oligonucleotide
ttctagagaagccaatcagtgtcgccgcag

SEQ ID NO: 425776 - DNA, 29 bp, Artificial Sequence
  Description of Artificial Sequence: Synthetic oligonucleotide
tctagagaagccaatcagtgtcgccgcag

SEQ ID NO: 425777 - DNA, 28 bp, Artificial Sequence
  Description of Artificial Sequence: Synthetic oligonucleotide
ctagagaagccaatcagtgtcgccgcag

SEQ ID NO: 425778 - DNA, 30 bp, Artificial Sequence
  Description of Artificial Sequence: Synthetic oligonucleotide
tagagaagccaatcagtgtcgccgcagttc

SEQ ID NO: 425779 - DNA, 29 bp, Artificial Sequence
  Description of Artificial Sequence: Synthetic oligonucleotide
agagaagccaatcagtgtcgccgcagttc

SEQ ID NO: 425780 - DNA, 28 bp, Artificial Sequence
  Description of Artificial Sequence: Synthetic oligonucleotide
gagaagccaatcagtgtcgccgcagttc

SEQ ID NO: 425781 - DNA, 28 bp, Artificial Sequence
  Description of Artificial Sequence: Synthetic oligonucleotide
agaagccaatcagtgtcgccgcagttcc

SEQ ID NO: 425782 - DNA, 27 bp, Artificial Sequence
  Description of Artificial Sequence: Synthetic oligonucleotide
gaagccaatcagtgtcgccgcagttcc

SEQ ID NO: 425783 - DNA, 27 bp, Artificial Sequence
  Description of Artificial Sequence: Synthetic oligonucleotide
aagccaatcagtgtcgccgcagttccc

SEQ ID NO: 425784 - DNA, 27 bp, Artificial Sequence
  Description of Artificial Sequence: Synthetic oligonucleotide
agccaatcagtgtcgccgcagttccca

SEQ ID NO: 425785 - DNA, 26 bp, Artificial Sequence
  Description of Artificial Sequence: Synthetic oligonucleotide
gccaatcagtgtcgccgcagttccca

SEQ ID NO: 425786 - DNA, 26 bp, Artificial Sequence
  Description of Artificial Sequence: Synthetic oligonucleotide
ccaatcagtgtcgccgcagttcccag

SEQ ID NO: 425787 - DNA, 27 bp, Artificial Sequence
  Description of Artificial Sequence: Synthetic oligonucleotide
caatcagtgtcgccgcagttcccaggt

SEQ ID NO: 425788 - DNA, 28 bp, Artificial Sequence
  Description of Artificial Sequence: Synthetic oligonucleotide
aatcagtgtcgccgcagttcccaggttc

SEQ ID NO: 425789 - DNA, 27 bp, Artificial Sequence
  Description of Artificial Sequence: Synthetic oligonucleotide
atcagtgtcgccgcagttcccaggttc

SEQ ID NO: 425790 - DNA, 27 bp, Artificial Sequence
  Description of Artificial Sequence: Synthetic oligonucleotide
tcagtgtcgccgcagttcccaggttct

SEQ ID NO: 425791 - DNA, 27 bp, Artificial Sequence
  Description of Artificial Sequence: Synthetic oligonucleotide
cagtgtcgccgcagttcccaggttcta

SEQ ID NO: 425792 - DNA, 29 bp, Artificial Sequence
  Description of Artificial Sequence: Synthetic oligonucleotide
agtgtcgccgcagttcccaggttctaaag

SEQ ID NO: 425793 - DNA, 28 bp, Artificial Sequence
  Description of Artificial Sequence: Synthetic oligonucleotide
gtgtcgccgcagttcccaggttctaaag

SEQ ID NO: 425794 - DNA, 29 bp, Artificial Sequence
  Description of Artificial Sequence: Synthetic oligonucleotide
tgtcgccgcagttcccaggttctaaagtc

SEQ ID NO: 425795 - DNA, 28 bp, Artificial Sequence
  Description of Artificial Sequence: Synthetic oligonucleotide
gtcgccgcagttcccaggttctaaagtc

SEQ ID NO: 425796 - DNA, 28 bp, Artificial Sequence
  Description of Artificial Sequence: Synthetic oligonucleotide
tcgccgcagttcccaggttctaaagtcc

SEQ ID NO: 425797 - DNA, 27 bp, Artificial Sequence
  Description of Artificial Sequence: Synthetic oligonucleotide
cgccgcagttcccaggttctaaagtcc

SEQ ID NO: 425798 - DNA, 27 bp, Artificial Sequence
  Description of Artificial Sequence: Synthetic oligonucleotide
gccgcagttcccaggttctaaagtccc

SEQ ID NO: 425799 - DNA, 28 bp, Artificial Sequence
  Description of Artificial Sequence: Synthetic oligonucleotide
ccgcagttcccaggttctaaagtcccac

SEQ ID NO: 425800 - DNA, 28 bp, Artificial Sequence
  Description of Artificial Sequence: Synthetic oligonucleotide
cgcagttcccaggttctaaagtcccacg

SEQ ID NO: 425801 - DNA, 28 bp, Artificial Sequence
  Description of Artificial Sequence: Synthetic oligonucleotide
gcagttcccaggttctaaagtcccacgc

SEQ ID NO: 425802 - DNA, 29 bp, Artificial Sequence
  Description of Artificial Sequence: Synthetic oligonucleotide
cagttcccaggttctaaagtcccacgcac

SEQ ID NO: 425803 - DNA, 29 bp, Artificial Sequence
  Description of Artificial Sequence: Synthetic oligonucleotide
agttcccaggttctaaagtcccacgcacc

SEQ ID NO: 425804 - DNA, 28 bp, Artificial Sequence
  Description of Artificial Sequence: Synthetic oligonucleotide
gttcccaggttctaaagtcccacgcacc

SEQ ID NO: 425805 - DNA, 28 bp, Artificial Sequence
  Description of Artificial Sequence: Synthetic oligonucleotide
ttcccaggttctaaagtcccacgcaccc

SEQ ID NO: 425806 - DNA, 27 bp, Artificial Sequence
  Description of Artificial Sequence: Synthetic oligonucleotide
tcccaggttctaaagtcccacgcaccc

SEQ ID NO: 425807 - DNA, 26 bp, Artificial Sequence
  Description of Artificial Sequence: Synthetic oligonucleotide
cccaggttctaaagtcccacgcaccc

SEQ ID NO: 425808 - DNA, 26 bp, Artificial Sequence
  Description of Artificial Sequence: Synthetic oligonucleotide
ccaggttctaaagtcccacgcacccc

SEQ ID NO: 425809 - DNA, 26 bp, Artificial Sequence
  Description of Artificial Sequence: Synthetic oligonucleotide
caggttctaaagtcccacgcaccccg

SEQ ID NO: 425810 - DNA, 26 bp, Artificial Sequence
  Description of Artificial Sequence: Synthetic oligonucleotide
aggttctaaagtcccacgcaccccgc

SEQ ID NO: 425811 - DNA, 25 bp, Artificial Sequence
  Description of Artificial Sequence: Synthetic oligonucleotide
ggttctaaagtcccacgcaccccgc

SEQ ID NO: 425812 - DNA, 25 bp, Artificial Sequence
  Description of Artificial Sequence: Synthetic oligonucleotide
gttctaaagtcccacgcaccccgcg

SEQ ID NO: 425813 - DNA, 25 bp, Artificial Sequence
  Description of Artificial Sequence: Synthetic oligonucleotide
ttctaaagtcccacgcaccccgcgg

SEQ ID NO: 425814 - DNA, 24 bp, Artificial Sequence
  Description of Artificial Sequence: Synthetic oligonucleotide
tctaaagtcccacgcaccccgcgg

SEQ ID NO: 425815 - DNA, 23 bp, Artificial Sequence
  Description of Artificial Sequence: Synthetic oligonucleotide
ctaaagtcccacgcaccccgcgg

SEQ ID NO: 425816 - DNA, 24 bp, Artificial Sequence
  Description of Artificial Sequence: Synthetic oligonucleotide
taaagtcccacgcaccccgcggga

SEQ ID NO: 425817 - DNA, 23 bp, Artificial Sequence
  Description of Artificial Sequence: Synthetic oligonucleotide
aaagtcccacgcaccccgcggga

SEQ ID NO: 425818 - DNA, 22 bp, Artificial Sequence
  Description of Artificial Sequence: Synthetic oligonucleotide
aagtcccacgcaccccgcggga

SEQ ID NO: 425819 - DNA, 21 bp, Artificial Sequence
  Description of Artificial Sequence: Synthetic oligonucleotide
agtcccacgcaccccgcggga

SEQ ID NO: 425820 - DNA, 20 bp, Artificial Sequence
  Description of Artificial Sequence: Synthetic oligonucleotide
gtcccacgcaccccgcggga

SEQ ID NO: 425821 - DNA, 21 bp, Artificial Sequence
  Description of Artificial Sequence: Synthetic oligonucleotide
tcccacgcaccccgcgggact

SEQ ID NO: 425822 - DNA, 20 bp, Artificial Sequence
  Description of Artificial Sequence: Synthetic oligonucleotide
cccacgcaccccgcgggact

SEQ ID NO: 425823 - DNA, 27 bp, Artificial Sequence
  Description of Artificial Sequence: Synthetic oligonucleotide
ccacgcaccccgcgggactcatatttt

SEQ ID NO: 425824 - DNA, 28 bp, Artificial Sequence
  Description of Artificial Sequence: Synthetic oligonucleotide
cacgcaccccgcgggactcatatttttc

SEQ ID NO: 425825 - DNA, 28 bp, Artificial Sequence
  Description of Artificial Sequence: Synthetic oligonucleotide
acgcaccccgcgggactcatatttttcc

SEQ ID NO: 425826 - DNA, 27 bp, Artificial Sequence
  Description of Artificial Sequence: Synthetic oligonucleotide
cgcaccccgcgggactcatatttttcc

SEQ ID NO: 425827 - DNA, 27 bp, Artificial Sequence
  Description of Artificial Sequence: Synthetic oligonucleotide
gcaccccgcgggactcatatttttccc

SEQ ID NO: 425828 - DNA, 28 bp, Artificial Sequence
  Description of Artificial Sequence: Synthetic oligonucleotide
caccccgcgggactcatatttttcccag

SEQ ID NO: 425829 - DNA, 29 bp, Artificial Sequence
  Description of Artificial Sequence: Synthetic oligonucleotide
accccgcgggactcatatttttcccagac

SEQ ID NO: 425830 - DNA, 28 bp, Artificial Sequence
  Description of Artificial Sequence: Synthetic oligonucleotide
ccccgcgggactcatatttttcccagac

SEQ ID NO: 425831 - DNA, 28 bp, Artificial Sequence
  Description of Artificial Sequence: Synthetic oligonucleotide
cccgcgggactcatatttttcccagacg

SEQ ID NO: 425832 - DNA, 28 bp, Artificial Sequence
  Description of Artificial Sequence: Synthetic oligonucleotide
ccgcgggactcatatttttcccagacgc

SEQ ID NO: 425833 - DNA, 28 bp, Artificial Sequence
  Description of Artificial Sequence: Synthetic oligonucleotide
cgcgggactcatatttttcccagacgcg

SEQ ID NO: 425834 - DNA, 28 bp, Artificial Sequence
  Description of Artificial Sequence: Synthetic oligonucleotide
gcgggactcatatttttcccagacgcgg

SEQ ID NO: 425835 - DNA, 29 bp, Artificial Sequence
  Description of Artificial Sequence: Synthetic oligonucleotide
cgggactcatatttttcccagacgcggag

SEQ ID NO: 425836 - DNA, 29 bp, Artificial Sequence
  Description of Artificial Sequence: Synthetic oligonucleotide
gggactcatatttttcccagacgcggagg

SEQ ID NO: 425837 - DNA, 31 bp, Artificial Sequence
  Description of Artificial Sequence: Synthetic oligonucleotide
ggactcatatttttcccagacgcggaggttg

SEQ ID NO: 425838 - DNA, 31 bp, Artificial Sequence
  Description of Artificial Sequence: Synthetic oligonucleotide
gactcatatttttcccagacgcggaggttgg

SEQ ID NO: 425839 - DNA, 31 bp, Artificial Sequence
  Description of Artificial Sequence: Synthetic oligonucleotide
actcatatttttcccagacgcggaggttggg

SEQ ID NO: 425840 - DNA, 30 bp, Artificial Sequence
  Description of Artificial Sequence: Synthetic oligonucleotide
ctcatatttttcccagacgcggaggttggg

SEQ ID NO: 425841 - DNA, 30 bp, Artificial Sequence
  Description of Artificial Sequence: Synthetic oligonucleotide
tcatatttttcccagacgcggaggttgggg

SEQ ID NO: 425842 - DNA, 29 bp, Artificial Sequence
  Description of Artificial Sequence: Synthetic oligonucleotide
catatttttcccagacgcggaggttgggg

SEQ ID NO: 425843 - DNA, 30 bp, Artificial Sequence
  Description of Artificial Sequence: Synthetic oligonucleotide
atatttttcccagacgcggaggttggggtc

SEQ ID NO: 425844 - DNA, 29 bp, Artificial Sequence
  Description of Artificial Sequence: Synthetic oligonucleotide
tatttttcccagacgcggaggttggggtc

SEQ ID NO: 425845 - DNA, 28 bp, Artificial Sequence
  Description of Artificial Sequence: Synthetic oligonucleotide
atttttcccagacgcggaggttggggtc

SEQ ID NO: 425846 - DNA, 27 bp, Artificial Sequence
  Description of Artificial Sequence: Synthetic oligonucleotide
tttttcccagacgcggaggttggggtc

SEQ ID NO: 425847 - DNA, 27 bp, Artificial Sequence
  Description of Artificial Sequence: Synthetic oligonucleotide
ttttcccagacgcggaggttggggtca

SEQ ID NO: 425848 - DNA, 27 bp, Artificial Sequence
  Description of Artificial Sequence: Synthetic oligonucleotide
tttcccagacgcggaggttggggtcat

SEQ ID NO: 425849 - DNA, 26 bp, Artificial Sequence
  Description of Artificial Sequence: Synthetic oligonucleotide
ttcccagacgcggaggttggggtcat

SEQ ID NO: 425850 - DNA, 25 bp, Artificial Sequence
  Description of Artificial Sequence: Synthetic oligonucleotide
tcccagacgcggaggttggggtcat

SEQ ID NO: 425851 - DNA, 24 bp, Artificial Sequence
  Description of Artificial Sequence: Synthetic oligonucleotide
cccagacgcggaggttggggtcat

SEQ ID NO: 425852 - DNA, 24 bp, Artificial Sequence
  Description of Artificial Sequence: Synthetic oligonucleotide
ccagacgcggaggttggggtcatg

SEQ ID NO: 425853 - DNA, 24 bp, Artificial Sequence
  Description of Artificial Sequence: Synthetic oligonucleotide
cagacgcggaggttggggtcatgg

SEQ ID NO: 425854 - DNA, 24 bp, Artificial Sequence
  Description of Artificial Sequence: Synthetic oligonucleotide
agacgcggaggttggggtcatggc

SEQ ID NO: 425855 - DNA, 23 bp, Artificial Sequence
  Description of Artificial Sequence: Synthetic oligonucleotide
gacgcggaggttggggtcatggc

SEQ ID NO: 425856 - DNA, 23 bp, Artificial Sequence
  Description of Artificial Sequence: Synthetic oligonucleotide
acgcggaggttggggtcatggcg

SEQ ID NO: 425857 - DNA, 22 bp, Artificial Sequence
  Description of Artificial Sequence: Synthetic oligonucleotide
cgcggaggttggggtcatggcg

SEQ ID NO: 425858 - DNA, 22 bp, Artificial Sequence
  Description of Artificial Sequence: Synthetic oligonucleotide
gcggaggttggggtcatggcgc

SEQ ID NO: 425859 - DNA, 22 bp, Artificial Sequence
  Description of Artificial Sequence: Synthetic oligonucleotide
cggaggttggggtcatggcgcc

SEQ ID NO: 425860 - DNA, 22 bp, Artificial Sequence
  Description of Artificial Sequence: Synthetic oligonucleotide
ggaggttggggtcatggcgccc

SEQ ID NO: 425861 - DNA, 22 bp, Artificial Sequence
  Description of Artificial Sequence: Synthetic oligonucleotide
gaggttggggtcatggcgcccc

SEQ ID NO: 425862 - DNA, 24 bp, Artificial Sequence
  Description of Artificial Sequence: Synthetic oligonucleotide
aggttggggtcatggcgccccgaa

SEQ ID NO: 425863 - DNA, 23 bp, Artificial Sequence
  Description of Artificial Sequence: Synthetic oligonucleotide
ggttggggtcatggcgccccgaa

SEQ ID NO: 425864 - DNA, 23 bp, Artificial Sequence
  Description of Artificial Sequence: Synthetic oligonucleotide
gttggggtcatggcgccccgaag

SEQ ID NO: 425865 - DNA, 23 bp, Artificial Sequence
  Description of Artificial Sequence: Synthetic oligonucleotide
ttggggtcatggcgccccgaagc

SEQ ID NO: 425866 - DNA, 22 bp, Artificial Sequence
  Description of Artificial Sequence: Synthetic oligonucleotide
tggggtcatggcgccccgaagc

SEQ ID NO: 425867 - DNA, 21 bp, Artificial Sequence
  Description of Artificial Sequence: Synthetic oligonucleotide
ggggtcatggcgccccgaagc

SEQ ID NO: 425868 - DNA, 22 bp, Artificial Sequence
  Description of Artificial Sequence: Synthetic oligonucleotide
gggtcatggcgccccgaagcct

SEQ ID NO: 425869 - DNA, 22 bp, Artificial Sequence
  Description of Artificial Sequence: Synthetic oligonucleotide
ggtcatggcgccccgaagcctc

SEQ ID NO: 425870 - DNA, 23 bp, Artificial Sequence
  Description of Artificial Sequence: Synthetic oligonucleotide
gtcatggcgccccgaagcctcct

SEQ ID NO: 425871 - DNA, 23 bp, Artificial Sequence
  Description of Artificial Sequence: Synthetic oligonucleotide
tcatggcgccccgaagcctcctc

SEQ ID NO: 425872 - DNA, 22 bp, Artificial Sequence
  Description of Artificial Sequence: Synthetic oligonucleotide
catggcgccccgaagcctcctc

SEQ ID NO: 425873 - DNA, 23 bp, Artificial Sequence
  Description of Artificial Sequence: Synthetic oligonucleotide
atggcgccccgaagcctcctcct

SEQ ID NO: 425874 - DNA, 22 bp, Artificial Sequence
  Description of Artificial Sequence: Synthetic oligonucleotide
tggcgccccgaagcctcctcct

SEQ ID NO: 425875 - DNA, 21 bp, Artificial Sequence
  Description of Artificial Sequence: Synthetic oligonucleotide
ggcgccccgaagcctcctcct

SEQ ID NO: 425876 - DNA, 21 bp, Artificial Sequence
  Description of Artificial Sequence: Synthetic oligonucleotide
gcgccccgaagcctcctcctg

SEQ ID NO: 425877 - DNA, 22 bp, Artificial Sequence
  Description of Artificial Sequence: Synthetic oligonucleotide
cgccccgaagcctcctcctgct

SEQ ID NO: 425878 - DNA, 22 bp, Artificial Sequence
  Description of Artificial Sequence: Synthetic oligonucleotide
gccccgaagcctcctcctgctg

SEQ ID NO: 425879 - DNA, 23 bp, Artificial Sequence
  Description of Artificial Sequence: Synthetic oligonucleotide
ccccgaagcctcctcctgctgct

SEQ ID NO: 425880 - DNA, 24 bp, Artificial Sequence
  Description of Artificial Sequence: Synthetic oligonucleotide
cccgaagcctcctcctgctgctct

SEQ ID NO: 425881 - DNA, 25 bp, Artificial Sequence
  Description of Artificial Sequence: Synthetic oligonucleotide
ccgaagcctcctcctgctgctctca

SEQ ID NO: 425882 - DNA, 25 bp, Artificial Sequence
  Description of Artificial Sequence: Synthetic oligonucleotide
cgaagcctcctcctgctgctctcag

SEQ ID NO: 425883 - DNA, 25 bp, Artificial Sequence
  Description of Artificial Sequence: Synthetic oligonucleotide
gaagcctcctcctgctgctctcagg

SEQ ID NO: 425884 - DNA, 25 bp, Artificial Sequence
  Description of Artificial Sequence: Synthetic oligonucleotide
aagcctcctcctgctgctctcaggg

SEQ ID NO: 425885 - DNA, 24 bp, Artificial Sequence
  Description of Artificial Sequence: Synthetic oligonucleotide
agcctcctcctgctgctctcaggg

SEQ ID NO: 425886 - DNA, 23 bp, Artificial Sequence
  Description of Artificial Sequence: Synthetic oligonucleotide
gcctcctcctgctgctctcaggg

SEQ ID NO: 425887 - DNA, 23 bp, Artificial Sequence
  Description of Artificial Sequence: Synthetic oligonucleotide
cctcctcctgctgctctcagggg

SEQ ID NO: 425888 - DNA, 23 bp, Artificial Sequence
  Description of Artificial Sequence: Synthetic oligonucleotide
ctcctcctgctgctctcaggggc

SEQ ID NO: 425889 - DNA, 23 bp, Artificial Sequence
  Description of Artificial Sequence: Synthetic oligonucleotide
tcctcctgctgctctcaggggcc

SEQ ID NO: 425890 - DNA, 22 bp, Artificial Sequence
  Description of Artificial Sequence: Synthetic oligonucleotide
cctcctgctgctctcaggggcc

SEQ ID NO: 425891 - DNA, 23 bp, Artificial Sequence
  Description of Artificial Sequence: Synthetic oligonucleotide
ctcctgctgctctcaggggccct

SEQ ID NO: 425892 - DNA, 23 bp, Artificial Sequence
  Description of Artificial Sequence: Synthetic oligonucleotide
tcctgctgctctcaggggccctg

SEQ ID NO: 425893 - DNA, 22 bp, Artificial Sequence
  Description of Artificial Sequence: Synthetic oligonucleotide
cctgctgctctcaggggccctg

SEQ ID NO: 425894 - DNA, 22 bp, Artificial Sequence
  Description of Artificial Sequence: Synthetic oligonucleotide
ctgctgctctcaggggccctgg

SEQ ID NO: 425895 - DNA, 22 bp, Artificial Sequence
  Description of Artificial Sequence: Synthetic oligonucleotide
tgctgctctcaggggccctggc

SEQ ID NO: 425896 - DNA, 21 bp, Artificial Sequence
  Description of Artificial Sequence: Synthetic oligonucleotide
gctgctctcaggggccctggc

SEQ ID NO: 425897 - DNA, 21 bp, Artificial Sequence
  Description of Artificial Sequence: Synthetic oligonucleotide
ctgctctcaggggccctggcc

SEQ ID NO: 425898 - DNA, 22 bp, Artificial Sequence
  Description of Artificial Sequence: Synthetic oligonucleotide
tgctctcaggggccctggccct

SEQ ID NO: 425899 - DNA, 21 bp, Artificial Sequence
  Description of Artificial Sequence: Synthetic oligonucleotide
gctctcaggggccctggccct

SEQ ID NO: 425900 - DNA, 22 bp, Artificial Sequence
  Description of Artificial Sequence: Synthetic oligonucleotide
ctctcaggggccctggccctga

SEQ ID NO: 425901 - DNA, 22 bp, Artificial Sequence
  Description of Artificial Sequence: Synthetic oligonucleotide
tctcaggggccctggccctgac

SEQ ID NO: 425902 - DNA, 21 bp, Artificial Sequence
  Description of Artificial Sequence: Synthetic oligonucleotide
ctcaggggccctggccctgac

SEQ ID NO: 425903 - DNA, 21 bp, Artificial Sequence
  Description of Artificial Sequence: Synthetic oligonucleotide
tcaggggccctggccctgacc

SEQ ID NO: 425904 - DNA, 20 bp, Artificial Sequence
  Description of Artificial Sequence: Synthetic oligonucleotide
caggggccctggccctgacc

SEQ ID NO: 425905 - DNA, 23 bp, Artificial Sequence
  Description of Artificial Sequence: Synthetic oligonucleotide
aggggccctggccctgaccgata

SEQ ID NO: 425906 - DNA, 22 bp, Artificial Sequence
  Description of Artificial Sequence: Synthetic oligonucleotide
ggggccctggccctgaccgata

SEQ ID NO: 425907 - DNA, 24 bp, Artificial Sequence
  Description of Artificial Sequence: Synthetic oligonucleotide
gggccctggccctgaccgatactt

SEQ ID NO: 425908 - DNA, 24 bp, Artificial Sequence
  Description of Artificial Sequence: Synthetic oligonucleotide
ggccctggccctgaccgatacttg

SEQ ID NO: 425909 - DNA, 24 bp, Artificial Sequence
  Description of Artificial Sequence: Synthetic oligonucleotide
gccctggccctgaccgatacttgg

SEQ ID NO: 425910 - DNA, 24 bp, Artificial Sequence
  Description of Artificial Sequence: Synthetic oligonucleotide
ccctggccctgaccgatacttggg

SEQ ID NO: 425911 - DNA, 24 bp, Artificial Sequence
  Description of Artificial Sequence: Synthetic oligonucleotide
cctggccctgaccgatacttgggc

SEQ ID NO: 425912 - DNA, 24 bp, Artificial Sequence
  Description of Artificial Sequence: Synthetic oligonucleotide
ctggccctgaccgatacttgggcg

SEQ ID NO: 425913 - DNA, 24 bp, Artificial Sequence
  Description of Artificial Sequence: Synthetic oligonucleotide
tggccctgaccgatacttgggcgg

SEQ ID NO: 425914 - DNA, 23 bp, Artificial Sequence
  Description of Artificial Sequence: Synthetic oligonucleotide
ggccctgaccgatacttgggcgg

SEQ ID NO: 425915 - DNA, 23 bp, Artificial Sequence
  Description of Artificial Sequence: Synthetic oligonucleotide
gccctgaccgatacttgggcggg

SEQ ID NO: 425916 - DNA, 24 bp, Artificial Sequence
  Description of Artificial Sequence: Synthetic oligonucleotide
ccctgaccgatacttgggcgggct

SEQ ID NO: 425917 - DNA, 24 bp, Artificial Sequence
  Description of Artificial Sequence: Synthetic oligonucleotide
cctgaccgatacttgggcgggctc

SEQ ID NO: 425918 - DNA, 24 bp, Artificial Sequence
  Description of Artificial Sequence: Synthetic oligonucleotide
ctgaccgatacttgggcgggctcc

SEQ ID NO: 425919 - DNA, 25 bp, Artificial Sequence
  Description of Artificial Sequence: Synthetic oligonucleotide
tgaccgatacttgggcgggctccca

SEQ ID NO: 425920 - DNA, 24 bp, Artificial Sequence
  Description of Artificial Sequence: Synthetic oligonucleotide
gaccgatacttgggcgggctccca

SEQ ID NO: 425921 - DNA, 25 bp, Artificial Sequence
  Description of Artificial Sequence: Synthetic oligonucleotide
accgatacttgggcgggctcccact

SEQ ID NO: 425922 - DNA, 24 bp, Artificial Sequence
  Description of Artificial Sequence: Synthetic oligonucleotide
ccgatacttgggcgggctcccact

SEQ ID NO: 425923 - DNA, 24 bp, Artificial Sequence
  Description of Artificial Sequence: Synthetic oligonucleotide
cgatacttgggcgggctcccactc

SEQ ID NO: 425924 - DNA, 26 bp, Artificial Sequence
  Description of Artificial Sequence: Synthetic oligonucleotide
gatacttgggcgggctcccactcctt

SEQ ID NO: 425925 - DNA, 27 bp, Artificial Sequence
  Description of Artificial Sequence: Synthetic oligonucleotide
atacttgggcgggctcccactccttga

SEQ ID NO: 425926 - DNA, 26 bp, Artificial Sequence
  Description of Artificial Sequence: Synthetic oligonucleotide
tacttgggcgggctcccactccttga

SEQ ID NO: 425927 - DNA, 25 bp, Artificial Sequence
  Description of Artificial Sequence: Synthetic oligonucleotide
acttgggcgggctcccactccttga

SEQ ID NO: 425928 - DNA, 24 bp, Artificial Sequence
  Description of Artificial Sequence: Synthetic oligonucleotide
cttgggcgggctcccactccttga

SEQ ID NO: 425929 - DNA, 24 bp, Artificial Sequence
  Description of Artificial Sequence: Synthetic oligonucleotide
ttgggcgggctcccactccttgag

SEQ ID NO: 425930 - DNA, 23 bp, Artificial Sequence
  Description of Artificial Sequence: Synthetic oligonucleotide
tgggcgggctcccactccttgag

SEQ ID NO: 425931 - DNA, 22 bp, Artificial Sequence
  Description of Artificial Sequence: Synthetic oligonucleotide
gggcgggctcccactccttgag

SEQ ID NO: 425932 - DNA, 27 bp, Artificial Sequence
  Description of Artificial Sequence: Synthetic oligonucleotide
ggcgggctcccactccttgaggtattt

SEQ ID NO: 425933 - DNA, 27 bp, Artificial Sequence
  Description of Artificial Sequence: Synthetic oligonucleotide
gcgggctcccactccttgaggtatttc

SEQ ID NO: 425934 - DNA, 28 bp, Artificial Sequence
  Description of Artificial Sequence: Synthetic oligonucleotide
cgggctcccactccttgaggtatttcag

SEQ ID NO: 425935 - DNA, 28 bp, Artificial Sequence
  Description of Artificial Sequence: Synthetic oligonucleotide
gggctcccactccttgaggtatttcagc

SEQ ID NO: 425936 - DNA, 29 bp, Artificial Sequence
  Description of Artificial Sequence: Synthetic oligonucleotide
ggctcccactccttgaggtatttcagcac

SEQ ID NO: 425937 - DNA, 29 bp, Artificial Sequence
  Description of Artificial Sequence: Synthetic oligonucleotide
gctcccactccttgaggtatttcagcacc

SEQ ID NO: 425938 - DNA, 29 bp, Artificial Sequence
  Description of Artificial Sequence: Synthetic oligonucleotide
ctcccactccttgaggtatttcagcaccg

SEQ ID NO: 425939 - DNA, 29 bp, Artificial Sequence
  Description of Artificial Sequence: Synthetic oligonucleotide
tcccactccttgaggtatttcagcaccgc

SEQ ID NO: 425940 - DNA, 28 bp, Artificial Sequence
  Description of Artificial Sequence: Synthetic oligonucleotide
cccactccttgaggtatttcagcaccgc

SEQ ID NO: 425941 - DNA, 29 bp, Artificial Sequence
  Description of Artificial Sequence: Synthetic oligonucleotide
ccactccttgaggtatttcagcaccgctg

SEQ ID NO: 425942 - DNA, 30 bp, Artificial Sequence; identical to SEQ ID NO: 76479
  Description of Artificial Sequence: Synthetic oligonucleotide

SEQ ID NO: 425943 - DNA, 31 bp, Artificial Sequence; identical to SEQ ID NO: 76480
  Description of Artificial Sequence: Synthetic oligonucleotide

SEQ ID NO: 425944 - DNA, 30 bp, Artificial Sequence; identical to SEQ ID NO: 76481
  Description of Artificial Sequence: Synthetic oligonucleotide

SEQ ID NO: 425945 - DNA, 30 bp, Artificial Sequence; identical to SEQ ID NO: 76482
  Description of Artificial Sequence: Synthetic oligonucleotide

SEQ ID NO: 425946 - DNA, 29 bp, Artificial Sequence
  Description of Artificial Sequence: Synthetic oligonucleotide
ccttgaggtatttcagcaccgctgtgtcg

SEQ ID NO: 425947 - DNA, 29 bp, Artificial Sequence
  Description of Artificial Sequence: Synthetic oligonucleotide
cttgaggtatttcagcaccgctgtgtcgc

SEQ ID NO: 425948 - DNA, 29 bp, Artificial Sequence
  Description of Artificial Sequence: Synthetic oligonucleotide
ttgaggtatttcagcaccgctgtgtcgcg

SEQ ID NO: 425949 - DNA, 28 bp, Artificial Sequence
  Description of Artificial Sequence: Synthetic oligonucleotide
tgaggtatttcagcaccgctgtgtcgcg

SEQ ID NO: 425950 - DNA, 27 bp, Artificial Sequence
  Description of Artificial Sequence: Synthetic oligonucleotide
gaggtatttcagcaccgctgtgtcgcg

SEQ ID NO: 425951 - DNA, 27 bp, Artificial Sequence
  Description of Artificial Sequence: Synthetic oligonucleotide
aggtatttcagcaccgctgtgtcgcgg

SEQ ID NO: 425952 - DNA, 26 bp, Artificial Sequence
  Description of Artificial Sequence: Synthetic oligonucleotide
ggtatttcagcaccgctgtgtcgcgg

SEQ ID NO: 425953 - DNA, 26 bp, Artificial Sequence
  Description of Artificial Sequence: Synthetic oligonucleotide
gtatttcagcaccgctgtgtcgcggc

SEQ ID NO: 425954 - DNA, 26 bp, Artificial Sequence
  Description of Artificial Sequence: Synthetic oligonucleotide
tatttcagcaccgctgtgtcgcggcc

SEQ ID NO: 425955 - DNA, 25 bp, Artificial Sequence
  Description of Artificial Sequence: Synthetic oligonucleotide
atttcagcaccgctgtgtcgcggcc

SEQ ID NO: 425956 - DNA, 24 bp, Artificial Sequence
  Description of Artificial Sequence: Synthetic oligonucleotide
tttcagcaccgctgtgtcgcggcc

SEQ ID NO: 425957 - DNA, 23 bp, Artificial Sequence
  Description of Artificial Sequence: Synthetic oligonucleotide
ttcagcaccgctgtgtcgcggcc

SEQ ID NO: 425958 - DNA, 22 bp, Artificial Sequence
  Description of Artificial Sequence: Synthetic oligonucleotide
tcagcaccgctgtgtcgcggcc

SEQ ID NO: 425959 - DNA, 21 bp, Artificial Sequence
  Description of Artificial Sequence: Synthetic oligonucleotide
cagcaccgctgtgtcgcggcc

SEQ ID NO: 425960 - DNA, 21 bp, Artificial Sequence
  Description of Artificial Sequence: Synthetic oligonucleotide
agcaccgctgtgtcgcggccc

SEQ ID NO: 425961 - DNA, 20 bp, Artificial Sequence
  Description of Artificial Sequence: Synthetic oligonucleotide
gcaccgctgtgtcgcggccc

SEQ ID NO: 425962 - DNA, 20 bp, Artificial Sequence
  Description of Artificial Sequence: Synthetic oligonucleotide
caccgctgtgtcgcggcccg

SEQ ID NO: 425963 - DNA, 20 bp, Artificial Sequence
  Description of Artificial Sequence: Synthetic oligonucleotide
accgctgtgtcgcggcccgg

SEQ ID NO: 425964 - DNA, 20 bp, Artificial Sequence
  Description of Artificial Sequence: Synthetic oligonucleotide
ccgctgtgtcgcggcccggt

SEQ ID NO: 425965 - DNA, 20 bp, Artificial Sequence
  Description of Artificial Sequence: Synthetic oligonucleotide
cgctgtgtcgcggcccggct

SEQ ID NO: 425966 - DNA, 20 bp, Artificial Sequence
  Description of Artificial Sequence: Synthetic oligonucleotide
gctgtgtcgcggcccggcct

SEQ ID NO: 425967 - DNA, 20 bp, Artificial Sequence
  Description of Artificial Sequence: Synthetic oligonucleotide
ctgtgtcgcggcccggccgt

SEQ ID NO: 425968 - DNA, 20 bp, Artificial Sequence
  Description of Artificial Sequence: Synthetic oligonucleotide
tgtgtcgcggcccggccgct

SEQ ID NO: 425969 - DNA, 20 bp, Artificial Sequence
  Description of Artificial Sequence: Synthetic oligonucleotide
gtgtcgcggcccggccgctt

SEQ ID NO: 425970 - DNA, 20 bp, Artificial Sequence
  Description of Artificial Sequence: Synthetic oligonucleotide
tgtcgcggcccggccgcgtt

SEQ ID NO: 425971 - DNA, 20 bp, Artificial Sequence
  Description of Artificial Sequence: Synthetic oligonucleotide
gtcgcggcccggccgcgttt

SEQ ID NO: 425972 - DNA, 20 bp, Artificial Sequence
  Description of Artificial Sequence: Synthetic oligonucleotide
tcgcggcccggccgcggttt

SEQ ID NO: 425973 - DNA, 20 bp, Artificial Sequence
  Description of Artificial Sequence: Synthetic oligonucleotide
cgcggcccggccgcggtttt

SEQ ID NO: 425974 - DNA, 20 bp, Artificial Sequence
  Description of Artificial Sequence: Synthetic oligonucleotide
gcggcccggccgcgggtttt

SEQ ID NO: 425975 - DNA, 20 bp, Artificial Sequence
  Description of Artificial Sequence: Synthetic oligonucleotide
gccgcggggagccccgctat

SEQ ID NO: 425976 - DNA, 21 bp, Artificial Sequence
  Description of Artificial Sequence: Synthetic oligonucleotide
ccgcggggagccccgctacat

SEQ ID NO: 425977 - DNA, 21 bp, Artificial Sequence
  Description of Artificial Sequence: Synthetic oligonucleotide
cgcggggagccccgctacatc

SEQ ID NO: 425978 - DNA, 21 bp, Artificial Sequence
  Description of Artificial Sequence: Synthetic oligonucleotide
gcggggagccccgctacatcg

SEQ ID NO: 425979 - DNA, 21 bp, Artificial Sequence
  Description of Artificial Sequence: Synthetic oligonucleotide
cggggagccccgctacatcgc

SEQ ID NO: 425980 - DNA, 21 bp, Artificial Sequence
  Description of Artificial Sequence: Synthetic oligonucleotide
ggggagccccgctacatcgcc

SEQ ID NO: 425981 - DNA, 22 bp, Artificial Sequence
  Description of Artificial Sequence: Synthetic oligonucleotide
gggagccccgctacatcgccgt

SEQ ID NO: 425982 - DNA, 22 bp, Artificial Sequence
  Description of Artificial Sequence: Synthetic oligonucleotide
ggagccccgctacatcgccgtg

SEQ ID NO: 425983 - DNA, 23 bp, Artificial Sequence
  Description of Artificial Sequence: Synthetic oligonucleotide
gagccccgctacatcgccgtgga

SEQ ID NO: 425984 - DNA, 25 bp, Artificial Sequence
  Description of Artificial Sequence: Synthetic oligonucleotide
agccccgctacatcgccgtggagta

SEQ ID NO: 425985 - DNA, 24 bp, Artificial Sequence
  Description of Artificial Sequence: Synthetic oligonucleotide
gccccgctacatcgccgtggagta

SEQ ID NO: 425986 - DNA, 24 bp, Artificial Sequence
  Description of Artificial Sequence: Synthetic oligonucleotide
ccccgctacatcgccgtggagtac

SEQ ID NO: 425987 - DNA, 26 bp, Artificial Sequence
  Description of Artificial Sequence: Synthetic oligonucleotide
cccgctacatcgccgtggagtacgta

SEQ ID NO: 425988 - DNA, 27 bp, Artificial Sequence
  Description of Artificial Sequence: Synthetic oligonucleotide
ccgctacatcgccgtggagtacgtaga

SEQ ID NO: 425989 - DNA, 27 bp, Artificial Sequence
  Description of Artificial Sequence: Synthetic oligonucleotide
cgctacatcgccgtggagtacgtagac

SEQ ID NO: 425990 - DNA, 27 bp, Artificial Sequence
  Description of Artificial Sequence: Synthetic oligonucleotide
gctacatcgccgtggagtacgtagacg

SEQ ID NO: 425991 - DNA, 28 bp, Artificial Sequence
  Description of Artificial Sequence: Synthetic oligonucleotide
ctacatcgccgtggagtacgtagacgac

SEQ ID NO: 425992 - DNA, 29 bp, Artificial Sequence
  Description of Artificial Sequence: Synthetic oligonucleotide
tacatcgccgtggagtacgtagacgacac

SEQ ID NO: 425993 - DNA, 28 bp, Artificial Sequence
  Description of Artificial Sequence: Synthetic oligonucleotide
acatcgccgtggagtacgtagacgacac

SEQ ID NO: 425994 - DNA, 27 bp, Artificial Sequence
  Description of Artificial Sequence: Synthetic oligonucleotide
catcgccgtggagtacgtagacgacac

SEQ ID NO: 425995 - DNA, 27 bp, Artificial Sequence
  Description of Artificial Sequence: Synthetic oligonucleotide
atcgccgtggagtacgtagacgacacg

SEQ ID NO: 425996 - DNA, 26 bp, Artificial Sequence
  Description of Artificial Sequence: Synthetic oligonucleotide
tcgccgtggagtacgtagacgacacg

SEQ ID NO: 425997 - DNA, 25 bp, Artificial Sequence
  Description of Artificial Sequence: Synthetic oligonucleotide
cgccgtggagtacgtagacgacacg

SEQ ID NO: 425998 - DNA, 27 bp, Artificial Sequence
  Description of Artificial Sequence: Synthetic oligonucleotide
gccgtggagtacgtagacgacacgcaa

SEQ ID NO: 425999 - DNA, 29 bp, Artificial Sequence
  Description of Artificial Sequence: Synthetic oligonucleotide
ccgtggagtacgtagacgacacgcaattc

SEQ ID NO: 426000 - DNA, 29 bp, Artificial Sequence
  Description of Artificial Sequence: Synthetic oligonucleotide
cgtggagtacgtagacgacacgcaattcc

SEQ ID NO: 426001 - DNA, 30 bp, Artificial Sequence; identical to SEQ ID NO: 76538
  Description of Artificial Sequence: Synthetic oligonucleotide

SEQ ID NO: 426002 - DNA, 30 bp, Artificial Sequence; identical to SEQ ID NO: 76539
  Description of Artificial Sequence: Synthetic oligonucleotide

SEQ ID NO: 426003 - DNA, 29 bp, Artificial Sequence
  Description of Artificial Sequence: Synthetic oligonucleotide
ggagtacgtagacgacacgcaattcctgc

SEQ ID NO: 426004 - DNA, 29 bp, Artificial Sequence
  Description of Artificial Sequence: Synthetic oligonucleotide
gagtacgtagacgacacgcaattcctgcg

SEQ ID NO: 426005 - DNA, 29 bp, Artificial Sequence
  Description of Artificial Sequence: Synthetic oligonucleotide
agtacgtagacgacacgcaattcctgcgg

SEQ ID NO: 426006 - DNA, 28 bp, Artificial Sequence
  Description of Artificial Sequence: Synthetic oligonucleotide
gtacgtagacgacacgcaattcctgcgg

SEQ ID NO: 426007 - DNA, 30 bp, Artificial Sequence; identical to SEQ ID NO: 76544
  Description of Artificial Sequence: Synthetic oligonucleotide

SEQ ID NO: 426008 - DNA, 29 bp, Artificial Sequence
  Description of Artificial Sequence: Synthetic oligonucleotide
acgtagacgacacgcaattcctgcggttc

SEQ ID NO: 426009 - DNA, 28 bp, Artificial Sequence
  Description of Artificial Sequence: Synthetic oligonucleotide
cgtagacgacacgcaattcctgcggttc

SEQ ID NO: 426010 - DNA, 28 bp, Artificial Sequence
  Description of Artificial Sequence: Synthetic oligonucleotide
gtagacgacacgcaattcctgcggttcg

SEQ ID NO: 426011 - DNA, 29 bp, Artificial Sequence
  Description of Artificial Sequence: Synthetic oligonucleotide
tagacgacacgcaattcctgcggttcgac

SEQ ID NO: 426012 - DNA, 28 bp, Artificial Sequence
  Description of Artificial Sequence: Synthetic oligonucleotide
agacgacacgcaattcctgcggttcgac

SEQ ID NO: 426013 - DNA, 27 bp, Artificial Sequence
  Description of Artificial Sequence: Synthetic oligonucleotide
gacgacacgcaattcctgcggttcgac

SEQ ID NO: 426014 - DNA, 28 bp, Artificial Sequence
  Description of Artificial Sequence: Synthetic oligonucleotide
acgacacgcaattcctgcggttcgacag

SEQ ID NO: 426015 - DNA, 27 bp, Artificial Sequence
  Description of Artificial Sequence: Synthetic oligonucleotide
cgacacgcaattcctgcggttcgacag

SEQ ID NO: 426016 - DNA, 27 bp, Artificial Sequence
  Description of Artificial Sequence: Synthetic oligonucleotide
gacacgcaattcctgcggttcgacagc

SEQ ID NO: 426017 - DNA, 27 bp, Artificial Sequence
  Description of Artificial Sequence: Synthetic oligonucleotide
acacgcaattcctgcggttcgacagcg

SEQ ID NO: 426018 - DNA, 27 bp, Artificial Sequence
  Description of Artificial Sequence: Synthetic oligonucleotide
cacgcaattcctgcggttcgacagcga

SEQ ID NO: 426019 - DNA, 27 bp, Artificial Sequence
  Description of Artificial Sequence: Synthetic oligonucleotide
acgcaattcctgcggttcgacagcgac

SEQ ID NO: 426020 - DNA, 26 bp, Artificial Sequence
  Description of Artificial Sequence: Synthetic oligonucleotide
cgcaattcctgcggttcgacagcgac

SEQ ID NO: 426021 - DNA, 26 bp, Artificial Sequence
  Description of Artificial Sequence: Synthetic oligonucleotide
gcaattcctgcggttcgacagcgacg

SEQ ID NO: 426022 - DNA, 26 bp, Artificial Sequence
  Description of Artificial Sequence: Synthetic oligonucleotide
caattcctgcggttcgacagcgacgc

SEQ ID NO: 426023 - DNA, 26 bp, Artificial Sequence
  Description of Artificial Sequence: Synthetic oligonucleotide
aattcctgcggttcgacagcgacgcc

SEQ ID NO: 426024 - DNA, 25 bp, Artificial Sequence
  Description of Artificial Sequence: Synthetic oligonucleotide
attcctgcggttcgacagcgacgcc

SEQ ID NO: 426025 - DNA, 24 bp, Artificial Sequence
  Description of Artificial Sequence: Synthetic oligonucleotide
ttcctgcggttcgacagcgacgcc

SEQ ID NO: 426026 - DNA, 23 bp, Artificial Sequence
  Description of Artificial Sequence: Synthetic oligonucleotide
tcctgcggttcgacagcgacgcc

SEQ ID NO: 426027 - DNA, 22 bp, Artificial Sequence
  Description of Artificial Sequence: Synthetic oligonucleotide
cctgcggttcgacagcgacgcc

SEQ ID NO: 426028 - DNA, 22 bp, Artificial Sequence
  Description of Artificial Sequence: Synthetic oligonucleotide
ctgcggttcgacagcgacgccg

SEQ ID NO: 426029 - DNA, 24 bp, Artificial Sequence
  Description of Artificial Sequence: Synthetic oligonucleotide
cggttcgacagcgacgccgcgatt

SEQ ID NO: 426030 - DNA, 24 bp, Artificial Sequence
  Description of Artificial Sequence: Synthetic oligonucleotide
ggttcgacagcgacgccgcgattc

SEQ ID NO: 426031 - DNA, 24 bp, Artificial Sequence
  Description of Artificial Sequence: Synthetic oligonucleotide
gttcgacagcgacgccgcgattcc

SEQ ID NO: 426032 - DNA, 25 bp, Artificial Sequence
  Description of Artificial Sequence: Synthetic oligonucleotide
ttcgacagcgacgccgcgattccga

SEQ ID NO: 426033 - DNA, 24 bp, Artificial Sequence
  Description of Artificial Sequence: Synthetic oligonucleotide
tcgacagcgacgccgcgattccga

SEQ ID NO: 426034 - DNA, 23 bp, Artificial Sequence
  Description of Artificial Sequence: Synthetic oligonucleotide
cgacagcgacgccgcgattccga

SEQ ID NO: 426035 - DNA, 23 bp, Artificial Sequence
  Description of Artificial Sequence: Synthetic oligonucleotide
gacagcgacgccgcgattccgag

SEQ ID NO: 426036 - DNA, 25 bp, Artificial Sequence
  Description of Artificial Sequence: Synthetic oligonucleotide
acagcgacgccgcgattccgaggat

SEQ ID NO: 426037 - DNA, 24 bp, Artificial Sequence
  Description of Artificial Sequence: Synthetic oligonucleotide
cagcgacgccgcgattccgaggat

SEQ ID NO: 426038 - DNA, 24 bp, Artificial Sequence
  Description of Artificial Sequence: Synthetic oligonucleotide
agcgacgccgcgattccgaggatg

SEQ ID NO: 426039 - DNA, 23 bp, Artificial Sequence
  Description of Artificial Sequence: Synthetic oligonucleotide
gcgacgccgcgattccgaggatg

SEQ ID NO: 426040 - DNA, 24 bp, Artificial Sequence
  Description of Artificial Sequence: Synthetic oligonucleotide
cgacgccgcgattccgaggatgga

SEQ ID NO: 426041 - DNA, 24 bp, Artificial Sequence
  Description of Artificial Sequence: Synthetic oligonucleotide
gacgccgcgattccgaggatggag

SEQ ID NO: 426042 - DNA, 24 bp, Artificial Sequence
  Description of Artificial Sequence: Synthetic oligonucleotide
acgccgcgattccgaggatggagc

SEQ ID NO: 426043 - DNA, 23 bp, Artificial Sequence
  Description of Artificial Sequence: Synthetic oligonucleotide
cgccgcgattccgaggatggagc

SEQ ID NO: 426044 - DNA, 23 bp, Artificial Sequence
  Description of Artificial Sequence: Synthetic oligonucleotide
gccgcgattccgaggatggagcc

SEQ ID NO: 426045 - DNA, 23 bp, Artificial Sequence
  Description of Artificial Sequence: Synthetic oligonucleotide
ccgcgattccgaggatggagccg

SEQ ID NO: 426046 - DNA, 23 bp, Artificial Sequence
  Description of Artificial Sequence: Synthetic oligonucleotide
cgcgattccgaggatggagccgc

SEQ ID NO: 426047 - DNA, 23 bp, Artificial Sequence
  Description of Artificial Sequence: Synthetic oligonucleotide
gcgattccgaggatggagccgcg

SEQ ID NO: 426048 - DNA, 23 bp, Artificial Sequence
  Description of Artificial Sequence: Synthetic oligonucleotide
cgattccgaggatggagccgcgg

SEQ ID NO: 426049 - DNA, 24 bp, Artificial Sequence
  Description of Artificial Sequence: Synthetic oligonucleotide
gattccgaggatggagccgcggga

SEQ ID NO: 426050 - DNA, 24 bp, Artificial Sequence
  Description of Artificial Sequence: Synthetic oligonucleotide
attccgaggatggagccgcgggag

SEQ ID NO: 426051 - DNA, 23 bp, Artificial Sequence
  Description of Artificial Sequence: Synthetic oligonucleotide
ttccgaggatggagccgcgggag

SEQ ID NO: 426052 - DNA, 22 bp, Artificial Sequence
  Description of Artificial Sequence: Synthetic oligonucleotide
tccgaggatggagccgcgggag

SEQ ID NO: 426053 - DNA, 21 bp, Artificial Sequence
  Description of Artificial Sequence: Synthetic oligonucleotide
ccgaggatggagccgcgggag

SEQ ID NO: 426054 - DNA, 21 bp, Artificial Sequence
  Description of Artificial Sequence: Synthetic oligonucleotide
cgaggatggagccgcgggagc

SEQ ID NO: 426055 - DNA, 21 bp, Artificial Sequence
  Description of Artificial Sequence: Synthetic oligonucleotide
gaggatggagccgcgggagcc

SEQ ID NO: 426056 - DNA, 22 bp, Artificial Sequence
  Description of Artificial Sequence: Synthetic oligonucleotide
aggatggagccgcgggagccgt

SEQ ID NO: 426057 - DNA, 21 bp, Artificial Sequence
  Description of Artificial Sequence: Synthetic oligonucleotide
ggatggagccgcgggagccgt

SEQ ID NO: 426058 - DNA, 21 bp, Artificial Sequence
  Description of Artificial Sequence: Synthetic oligonucleotide
gatggagccgcgggagccgtg

SEQ ID NO: 426059 - DNA, 21 bp, Artificial Sequence
  Description of Artificial Sequence: Synthetic oligonucleotide
atggagccgcgggagccgtgg

SEQ ID NO: 426060 - DNA, 20 bp, Artificial Sequence
  Description of Artificial Sequence: Synthetic oligonucleotide
tggagccgcgggagccgtgg

SEQ ID NO: 426061 - DNA, 22 bp, Artificial Sequence
  Description of Artificial Sequence: Synthetic oligonucleotide
gcgggagccgtgggtggagcaa

SEQ ID NO: 426062 - DNA, 23 bp, Artificial Sequence
  Description of Artificial Sequence: Synthetic oligonucleotide
cgggagccgtgggtggagcaaga

SEQ ID NO: 426063 - DNA, 23 bp, Artificial Sequence
  Description of Artificial Sequence: Synthetic oligonucleotide
gggagccgtgggtggagcaagag

SEQ ID NO: 426064 - DNA, 23 bp, Artificial Sequence
  Description of Artificial Sequence: Synthetic oligonucleotide
ggagccgtgggtggagcaagagg

SEQ ID NO: 426065 - DNA, 23 bp, Artificial Sequence
  Description of Artificial Sequence: Synthetic oligonucleotide
gagccgtgggtggagcaagaggg

SEQ ID NO: 426066 - DNA, 23 bp, Artificial Sequence
  Description of Artificial Sequence: Synthetic oligonucleotide
agccgtgggtggagcaagagggg

SEQ ID NO: 426067 - DNA, 22 bp, Artificial Sequence
  Description of Artificial Sequence: Synthetic oligonucleotide
gccgtgggtggagcaagagggg

SEQ ID NO: 426068 - DNA, 22 bp, Artificial Sequence
  Description of Artificial Sequence: Synthetic oligonucleotide
ccgtgggtggagcaagaggggc

SEQ ID NO: 426069 - DNA, 22 bp, Artificial Sequence
  Description of Artificial Sequence: Synthetic oligonucleotide
cgtgggtggagcaagaggggcc

SEQ ID NO: 426070 - DNA, 22 bp, Artificial Sequence
  Description of Artificial Sequence: Synthetic oligonucleotide
gtgggtggagcaagaggggccg

SEQ ID NO: 426071 - DNA, 23 bp, Artificial Sequence
  Description of Artificial Sequence: Synthetic oligonucleotide
tgggtggagcaagaggggccgca

SEQ ID NO: 426072 - DNA, 22 bp, Artificial Sequence
  Description of Artificial Sequence: Synthetic oligonucleotide
gggtggagcaagaggggccgca

SEQ ID NO: 426073 - DNA, 26 bp, Artificial Sequence
  Description of Artificial Sequence: Synthetic oligonucleotide
ggtggagcaagaggggccgcagtatt

SEQ ID NO: 426074 - DNA, 26 bp, Artificial Sequence
  Description of Artificial Sequence: Synthetic oligonucleotide
gtggagcaagaggggccgcagtattg

SEQ ID NO: 426075 - DNA, 26 bp, Artificial Sequence
  Description of Artificial Sequence: Synthetic oligonucleotide
tggagcaagaggggccgcagtattgg

SEQ ID NO: 426076 - DNA, 25 bp, Artificial Sequence
  Description of Artificial Sequence: Synthetic oligonucleotide
ggagcaagaggggccgcagtattgg

SEQ ID NO: 426077 - DNA, 26 bp, Artificial Sequence
  Description of Artificial Sequence: Synthetic oligonucleotide
gagcaagaggggccgcagtattggga

SEQ ID NO: 426078 - DNA, 27 bp, Artificial Sequence
  Description of Artificial Sequence: Synthetic oligonucleotide
agcaagaggggccgcagtattgggagt

SEQ ID NO: 426079 - DNA, 26 bp, Artificial Sequence
  Description of Artificial Sequence: Synthetic oligonucleotide
gcaagaggggccgcagtattgggagt

SEQ ID NO: 426080 - DNA, 26 bp, Artificial Sequence
  Description of Artificial Sequence: Synthetic oligonucleotide
caagaggggccgcagtattgggagtg

SEQ ID NO: 426081 - DNA, 27 bp, Artificial Sequence
  Description of Artificial Sequence: Synthetic oligonucleotide
aagaggggccgcagtattgggagtgga

SEQ ID NO: 426082 - DNA, 26 bp, Artificial Sequence
  Description of Artificial Sequence: Synthetic oligonucleotide
agaggggccgcagtattgggagtgga

SEQ ID NO: 426083 - DNA, 25 bp, Artificial Sequence
  Description of Artificial Sequence: Synthetic oligonucleotide
gaggggccgcagtattgggagtgga

SEQ ID NO: 426084 - DNA, 25 bp, Artificial Sequence
  Description of Artificial Sequence: Synthetic oligonucleotide
aggggccgcagtattgggagtggac

SEQ ID NO: 426085 - DNA, 24 bp, Artificial Sequence
  Description of Artificial Sequence: Synthetic oligonucleotide
ggggccgcagtattgggagtggac

SEQ ID NO: 426086 - DNA, 25 bp, Artificial Sequence
  Description of Artificial Sequence: Synthetic oligonucleotide
gggccgcagtattgggagtggacca

SEQ ID NO: 426087 - DNA, 26 bp, Artificial Sequence
  Description of Artificial Sequence: Synthetic oligonucleotide
ggccgcagtattgggagtggaccaca

SEQ ID NO: 426088 - DNA, 26 bp, Artificial Sequence
  Description of Artificial Sequence: Synthetic oligonucleotide
gccgcagtattgggagtggaccacag

SEQ ID NO: 426089 - DNA, 26 bp, Artificial Sequence
  Description of Artificial Sequence: Synthetic oligonucleotide
ccgcagtattgggagtggaccacagg

SEQ ID NO: 426090 - DNA, 27 bp, Artificial Sequence
  Description of Artificial Sequence: Synthetic oligonucleotide
cgcagtattgggagtggaccacagggt

SEQ ID NO: 426091 - DNA, 28 bp, Artificial Sequence
  Description of Artificial Sequence: Synthetic oligonucleotide
gcagtattgggagtggaccacagggtac

SEQ ID NO: 426092 - DNA, 28 bp, Artificial Sequence
  Description of Artificial Sequence: Synthetic oligonucleotide
cagtattgggagtggaccacagggtacg

SEQ ID NO: 426093 - DNA, 28 bp, Artificial Sequence
  Description of Artificial Sequence: Synthetic oligonucleotide
agtattgggagtggaccacagggtacgc

SEQ ID NO: 426094 - DNA, 27 bp, Artificial Sequence
  Description of Artificial Sequence: Synthetic oligonucleotide
gtattgggagtggaccacagggtacgc

SEQ ID NO: 426095 - DNA, 27 bp, Artificial Sequence
  Description of Artificial Sequence: Synthetic oligonucleotide
tattgggagtggaccacagggtacgcc

SEQ ID NO: 426096 - DNA, 27 bp, Artificial Sequence
  Description of Artificial Sequence: Synthetic oligonucleotide
attgggagtggaccacagggtacgcca

SEQ ID NO: 426097 - DNA, 27 bp, Artificial Sequence
  Description of Artificial Sequence: Synthetic oligonucleotide
ttgggagtggaccacagggtacgccaa

SEQ ID NO: 426098 - DNA, 26 bp, Artificial Sequence
  Description of Artificial Sequence: Synthetic oligonucleotide
tgggagtggaccacagggtacgccaa

SEQ ID NO: 426099 - DNA, 25 bp, Artificial Sequence
  Description of Artificial Sequence: Synthetic oligonucleotide
gggagtggaccacagggtacgccaa

SEQ ID NO: 426100 - DNA, 25 bp, Artificial Sequence
  Description of Artificial Sequence: Synthetic oligonucleotide
ggagtggaccacagggtacgccaag

SEQ ID NO: 426101 - DNA, 25 bp, Artificial Sequence
  Description of Artificial Sequence: Synthetic oligonucleotide
gagtggaccacagggtacgccaagg

SEQ ID NO: 426102 - DNA, 25 bp, Artificial Sequence
  Description of Artificial Sequence: Synthetic oligonucleotide
agtggaccacagggtacgccaaggc

SEQ ID NO: 426103 - DNA, 24 bp, Artificial Sequence
  Description of Artificial Sequence: Synthetic oligonucleotide
gtggaccacagggtacgccaaggc

SEQ ID NO: 426104 - DNA, 26 bp, Artificial Sequence
  Description of Artificial Sequence: Synthetic oligonucleotide
tggaccacagggtacgccaaggccaa

SEQ ID NO: 426105 - DNA, 25 bp, Artificial Sequence
  Description of Artificial Sequence: Synthetic oligonucleotide
ggaccacagggtacgccaaggccaa

SEQ ID NO: 426106 - DNA, 25 bp, Artificial Sequence
  Description of Artificial Sequence: Synthetic oligonucleotide
gaccacagggtacgccaaggccaac

SEQ ID NO: 426107 - DNA, 25 bp, Artificial Sequence
  Description of Artificial Sequence: Synthetic oligonucleotide
accacagggtacgccaaggccaacg

SEQ ID NO: 426108 - DNA, 24 bp, Artificial Sequence
  Description of Artificial Sequence: Synthetic oligonucleotide
ccacagggtacgccaaggccaacg

SEQ ID NO: 426109 - DNA, 25 bp, Artificial Sequence
  Description of Artificial Sequence: Synthetic oligonucleotide
cacagggtacgccaaggccaacgca

SEQ ID NO: 426110 - DNA, 26 bp, Artificial Sequence
  Description of Artificial Sequence: Synthetic oligonucleotide
acagggtacgccaaggccaacgcaca

SEQ ID NO: 426111 - DNA, 25 bp, Artificial Sequence
  Description of Artificial Sequence: Synthetic oligonucleotide
cagggtacgccaaggccaacgcaca

SEQ ID NO: 426112 - DNA, 26 bp, Artificial Sequence
  Description of Artificial Sequence: Synthetic oligonucleotide
agggtacgccaaggccaacgcacaga

SEQ ID NO: 426113 - DNA, 25 bp, Artificial Sequence
  Description of Artificial Sequence: Synthetic oligonucleotide
gggtacgccaaggccaacgcacaga

SEQ ID NO: 426114 - DNA, 26 bp, Artificial Sequence
  Description of Artificial Sequence: Synthetic oligonucleotide
ggtacgccaaggccaacgcacagact

SEQ ID NO: 426115 - DNA, 27 bp, Artificial Sequence
  Description of Artificial Sequence: Synthetic oligonucleotide
gtacgccaaggccaacgcacagactga

SEQ ID NO: 426116 - DNA, 27 bp, Artificial Sequence
  Description of Artificial Sequence: Synthetic oligonucleotide
tacgccaaggccaacgcacagactgac

SEQ ID NO: 426117 - DNA, 26 bp, Artificial Sequence
  Description of Artificial Sequence: Synthetic oligonucleotide
acgccaaggccaacgcacagactgac

SEQ ID NO: 426118 - DNA, 25 bp, Artificial Sequence
  Description of Artificial Sequence: Synthetic oligonucleotide
cgccaaggccaacgcacagactgac

SEQ ID NO: 426119 - DNA, 25 bp, Artificial Sequence
  Description of Artificial Sequence: Synthetic oligonucleotide
gccaaggccaacgcacagactgacc

SEQ ID NO: 426120 - DNA, 26 bp, Artificial Sequence
  Description of Artificial Sequence: Synthetic oligonucleotide
ccaaggccaacgcacagactgaccga

SEQ ID NO: 426121 - DNA, 27 bp, Artificial Sequence
  Description of Artificial Sequence: Synthetic oligonucleotide
caaggccaacgcacagactgaccgagt

SEQ ID NO: 426122 - DNA, 27 bp, Artificial Sequence
  Description of Artificial Sequence: Synthetic oligonucleotide
aaggccaacgcacagactgaccgagtg

SEQ ID NO: 426123 - DNA, 26 bp, Artificial Sequence
  Description of Artificial Sequence: Synthetic oligonucleotide
aggccaacgcacagactgaccgagtg

SEQ ID NO: 426124 - DNA, 25 bp, Artificial Sequence
  Description of Artificial Sequence: Synthetic oligonucleotide
ggccaacgcacagactgaccgagtg

SEQ ID NO: 426125 - DNA, 25 bp, Artificial Sequence
  Description of Artificial Sequence: Synthetic oligonucleotide
gccaacgcacagactgaccgagtgg

SEQ ID NO: 426126 - DNA, 25 bp, Artificial Sequence
  Description of Artificial Sequence: Synthetic oligonucleotide
ccaacgcacagactgaccgagtggc

SEQ ID NO: 426127 - DNA, 25 bp, Artificial Sequence
  Description of Artificial Sequence: Synthetic oligonucleotide
caacgcacagactgaccgagtggcc

SEQ ID NO: 426128 - DNA, 26 bp, Artificial Sequence
  Description of Artificial Sequence: Synthetic oligonucleotide
aacgcacagactgaccgagtggccct

SEQ ID NO: 426129 - DNA, 25 bp, Artificial Sequence
  Description of Artificial Sequence: Synthetic oligonucleotide
acgcacagactgaccgagtggccct

SEQ ID NO: 426130 - DNA, 24 bp, Artificial Sequence
  Description of Artificial Sequence: Synthetic oligonucleotide
cgcacagactgaccgagtggccct

SEQ ID NO: 426131 - DNA, 25 bp, Artificial Sequence
  Description of Artificial Sequence: Synthetic oligonucleotide
gcacagactgaccgagtggccctga

SEQ ID NO: 426132 - DNA, 25 bp, Artificial Sequence
  Description of Artificial Sequence: Synthetic oligonucleotide
cacagactgaccgagtggccctgag

SEQ ID NO: 426133 - DNA, 27 bp, Artificial Sequence
  Description of Artificial Sequence: Synthetic oligonucleotide
acagactgaccgagtggccctgaggaa

SEQ ID NO: 426134 - DNA, 26 bp, Artificial Sequence
  Description of Artificial Sequence: Synthetic oligonucleotide
cagactgaccgagtggccctgaggaa

SEQ ID NO: 426135 - DNA, 26 bp, Artificial Sequence
  Description of Artificial Sequence: Synthetic oligonucleotide
agactgaccgagtggccctgaggaac

SEQ ID NO: 426136 - DNA, 25 bp, Artificial Sequence
  Description of Artificial Sequence: Synthetic oligonucleotide
gactgaccgagtggccctgaggaac

SEQ ID NO: 426137 - DNA, 26 bp, Artificial Sequence
  Description of Artificial Sequence: Synthetic oligonucleotide
actgaccgagtggccctgaggaacct

SEQ ID NO: 426138 - DNA, 25 bp, Artificial Sequence
  Description of Artificial Sequence: Synthetic oligonucleotide
ctgaccgagtggccctgaggaacct

SEQ ID NO: 426139 - DNA, 25 bp, Artificial Sequence
  Description of Artificial Sequence: Synthetic oligonucleotide
tgaccgagtggccctgaggaacctg

SEQ ID NO: 426140 - DNA, 24 bp, Artificial Sequence
  Description of Artificial Sequence: Synthetic oligonucleotide
gaccgagtggccctgaggaacctg

SEQ ID NO: 426141 - DNA, 25 bp, Artificial Sequence
  Description of Artificial Sequence: Synthetic oligonucleotide
accgagtggccctgaggaacctgct

SEQ ID NO: 426142 - DNA, 24 bp, Artificial Sequence
  Description of Artificial Sequence: Synthetic oligonucleotide
ccgagtggccctgaggaacctgct

SEQ ID NO: 426143 - DNA, 24 bp, Artificial Sequence
  Description of Artificial Sequence: Synthetic oligonucleotide
cgagtggccctgaggaacctgctc

SEQ ID NO: 426144 - DNA, 24 bp, Artificial Sequence
  Description of Artificial Sequence: Synthetic oligonucleotide
gagtggccctgaggaacctgctcc

SEQ ID NO: 426145 - DNA, 24 bp, Artificial Sequence
  Description of Artificial Sequence: Synthetic oligonucleotide
agtggccctgaggaacctgctccg

SEQ ID NO: 426146 - DNA, 23 bp, Artificial Sequence
  Description of Artificial Sequence: Synthetic oligonucleotide
gtggccctgaggaacctgctccg

SEQ ID NO: 426147 - DNA, 23 bp, Artificial Sequence
  Description of Artificial Sequence: Synthetic oligonucleotide
tggccctgaggaacctgctccgc

SEQ ID NO: 426148 - DNA, 22 bp, Artificial Sequence
  Description of Artificial Sequence: Synthetic oligonucleotide
ggccctgaggaacctgctccgc

SEQ ID NO: 426149 - DNA, 22 bp, Artificial Sequence
  Description of Artificial Sequence: Synthetic oligonucleotide
gccctgaggaacctgctccgcc

SEQ ID NO: 426150 - DNA, 22 bp, Artificial Sequence
  Description of Artificial Sequence: Synthetic oligonucleotide
ccctgaggaacctgctccgccg

SEQ ID NO: 426151 - DNA, 24 bp, Artificial Sequence
  Description of Artificial Sequence: Synthetic oligonucleotide
cctgaggaacctgctccgccgcta

SEQ ID NO: 426152 - DNA, 26 bp, Artificial Sequence
  Description of Artificial Sequence: Synthetic oligonucleotide
ctgaggaacctgctccgccgctacaa

SEQ ID NO: 426153 - DNA, 26 bp, Artificial Sequence
  Description of Artificial Sequence: Synthetic oligonucleotide
tgaggaacctgctccgccgctacaac

SEQ ID NO: 426154 - DNA, 25 bp, Artificial Sequence
  Description of Artificial Sequence: Synthetic oligonucleotide
gaggaacctgctccgccgctacaac

SEQ ID NO: 426155 - DNA, 26 bp, Artificial Sequence
  Description of Artificial Sequence: Synthetic oligonucleotide
aggaacctgctccgccgctacaacca

SEQ ID NO: 426156 - DNA, 25 bp, Artificial Sequence
  Description of Artificial Sequence: Synthetic oligonucleotide
ggaacctgctccgccgctacaacca

SEQ ID NO: 426157 - DNA, 26 bp, Artificial Sequence
  Description of Artificial Sequence: Synthetic oligonucleotide
gaacctgctccgccgctacaaccaga

SEQ ID NO: 426158 - DNA, 26 bp, Artificial Sequence
  Description of Artificial Sequence: Synthetic oligonucleotide
aacctgctccgccgctacaaccagag

SEQ ID NO: 426159 - DNA, 25 bp, Artificial Sequence
  Description of Artificial Sequence: Synthetic oligonucleotide
acctgctccgccgctacaaccagag

SEQ ID NO: 426160 - DNA, 24 bp, Artificial Sequence
  Description of Artificial Sequence: Synthetic oligonucleotide
cctgctccgccgctacaaccagag

SEQ ID NO: 426161 - DNA, 24 bp, Artificial Sequence
  Description of Artificial Sequence: Synthetic oligonucleotide
ctgctccgccgctacaaccagagc

SEQ ID NO: 426162 - DNA, 25 bp, Artificial Sequence
  Description of Artificial Sequence: Synthetic oligonucleotide
tgctccgccgctacaaccagagcga

SEQ ID NO: 426163 - DNA, 24 bp, Artificial Sequence
  Description of Artificial Sequence: Synthetic oligonucleotide
gctccgccgctacaaccagagcga

SEQ ID NO: 426164 - DNA, 24 bp, Artificial Sequence
  Description of Artificial Sequence: Synthetic oligonucleotide
ctccgccgctacaaccagagcgag

SEQ ID NO: 426165 - DNA, 24 bp, Artificial Sequence
  Description of Artificial Sequence: Synthetic oligonucleotide
tccgccgctacaaccagagcgagg

SEQ ID NO: 426166 - DNA, 23 bp, Artificial Sequence
  Description of Artificial Sequence: Synthetic oligonucleotide
ccgccgctacaaccagagcgagg

SEQ ID NO: 426167 - DNA, 24 bp, Artificial Sequence
  Description of Artificial Sequence: Synthetic oligonucleotide
cgccgctacaaccagagcgaggct

SEQ ID NO: 426168 - DNA, 24 bp, Artificial Sequence
  Description of Artificial Sequence: Synthetic oligonucleotide
gccgctacaaccagagcgaggctg

SEQ ID NO: 426169 - DNA, 24 bp, Artificial Sequence
  Description of Artificial Sequence: Synthetic oligonucleotide
ccgctacaaccagagcgaggctgg

SEQ ID NO: 426170 - DNA, 25 bp, Artificial Sequence
  Description of Artificial Sequence: Synthetic oligonucleotide
cgctacaaccagagcgaggctgggt

SEQ ID NO: 426171 - DNA, 26 bp, Artificial Sequence
  Description of Artificial Sequence: Synthetic oligonucleotide
gctacaaccagagcgaggctgggtct

SEQ ID NO: 426172 - DNA, 26 bp, Artificial Sequence
  Description of Artificial Sequence: Synthetic oligonucleotide
caaccagagcgaggctgggtctcaca

SEQ ID NO: 426173 - DNA, 26 bp, Artificial Sequence
  Description of Artificial Sequence: Synthetic oligonucleotide
aaccagagcgaggctgggtctcacac

SEQ ID NO: 426174 - DNA, 25 bp, Artificial Sequence
  Description of Artificial Sequence: Synthetic oligonucleotide
accagagcgaggctgggtctcacac

SEQ ID NO: 426175 - DNA, 24 bp, Artificial Sequence
  Description of Artificial Sequence: Synthetic oligonucleotide
ccagagcgaggctgggtctcacac

SEQ ID NO: 426176 - DNA, 24 bp, Artificial Sequence
  Description of Artificial Sequence: Synthetic oligonucleotide
cagagcgaggctgggtctcacacc

SEQ ID NO: 426177 - DNA, 25 bp, Artificial Sequence
  Description of Artificial Sequence: Synthetic oligonucleotide
agagcgaggctgggtctcacaccct

SEQ ID NO: 426178 - DNA, 24 bp, Artificial Sequence
  Description of Artificial Sequence: Synthetic oligonucleotide
gagcgaggctgggtctcacaccct

SEQ ID NO: 426179 - DNA, 24 bp, Artificial Sequence
  Description of Artificial Sequence: Synthetic oligonucleotide
agcgaggctgggtctcacaccctc

SEQ ID NO: 426180 - DNA, 23 bp, Artificial Sequence
  Description of Artificial Sequence: Synthetic oligonucleotide
gcgaggctgggtctcacaccctc

SEQ ID NO: 426181 - DNA, 24 bp, Artificial Sequence
  Description of Artificial Sequence: Synthetic oligonucleotide
cgaggctgggtctcacaccctcca

SEQ ID NO: 426182 - DNA, 24 bp, Artificial Sequence
  Description of Artificial Sequence: Synthetic oligonucleotide
gaggctgggtctcacaccctccag

SEQ ID NO: 426183 - DNA, 24 bp, Artificial Sequence
  Description of Artificial Sequence: Synthetic oligonucleotide
aggctgggtctcacaccctccagg

SEQ ID NO: 426184 - DNA, 23 bp, Artificial Sequence
  Description of Artificial Sequence: Synthetic oligonucleotide
ggctgggtctcacaccctccagg

SEQ ID NO: 426185 - DNA, 26 bp, Artificial Sequence
  Description of Artificial Sequence: Synthetic oligonucleotide
gctgggtctcacaccctccagggaat

SEQ ID NO: 426186 - DNA, 27 bp, Artificial Sequence
  Description of Artificial Sequence: Synthetic oligonucleotide
ctgggtctcacaccctccagggaatga

SEQ ID NO: 426187 - DNA, 29 bp, Artificial Sequence
  Description of Artificial Sequence: Synthetic oligonucleotide
tgggtctcacaccctccagggaatgaatg

SEQ ID NO: 426188 - DNA, 28 bp, Artificial Sequence
  Description of Artificial Sequence: Synthetic oligonucleotide
gggtctcacaccctccagggaatgaatg

SEQ ID NO: 426189 - DNA, 28 bp, Artificial Sequence
  Description of Artificial Sequence: Synthetic oligonucleotide
ggtctcacaccctccagggaatgaatgg

SEQ ID NO: 426190 - DNA, 28 bp, Artificial Sequence
  Description of Artificial Sequence: Synthetic oligonucleotide
gtctcacaccctccagggaatgaatggc

SEQ ID NO: 426191 - DNA, 29 bp, Artificial Sequence
  Description of Artificial Sequence: Synthetic oligonucleotide
tctcacaccctccagggaatgaatggctg

SEQ ID NO: 426192 - DNA, 28 bp, Artificial Sequence
  Description of Artificial Sequence: Synthetic oligonucleotide
ctcacaccctccagggaatgaatggctg

SEQ ID NO: 426193 - DNA, 28 bp, Artificial Sequence
  Description of Artificial Sequence: Synthetic oligonucleotide
tcacaccctccagggaatgaatggctgc

SEQ ID NO: 426194 - DNA, 27 bp, Artificial Sequence
  Description of Artificial Sequence: Synthetic oligonucleotide
cacaccctccagggaatgaatggctgc

SEQ ID NO: 426195 - DNA, 27 bp, Artificial Sequence
  Description of Artificial Sequence: Synthetic oligonucleotide
acaccctccagggaatgaatggctgcg

SEQ ID NO: 426196 - DNA, 27 bp, Artificial Sequence
  Description of Artificial Sequence: Synthetic oligonucleotide
caccctccagggaatgaatggctgcga

SEQ ID NO: 426197 - DNA, 27 bp, Artificial Sequence
  Description of Artificial Sequence: Synthetic oligonucleotide
accctccagggaatgaatggctgcgac

SEQ ID NO: 426198 - DNA, 27 bp, Artificial Sequence
  Description of Artificial Sequence: Synthetic oligonucleotide
ccctccagggaatgaatggctgcgaca

SEQ ID NO: 426199 - DNA, 28 bp, Artificial Sequence
  Description of Artificial Sequence: Synthetic oligonucleotide
cctccagggaatgaatggctgcgacatg

SEQ ID NO: 426200 - DNA, 28 bp, Artificial Sequence
  Description of Artificial Sequence: Synthetic oligonucleotide
ctccagggaatgaatggctgcgacatgg

SEQ ID NO: 426201 - DNA, 28 bp, Artificial Sequence
  Description of Artificial Sequence: Synthetic oligonucleotide
tccagggaatgaatggctgcgacatggg

SEQ ID NO: 426202 - DNA, 27 bp, Artificial Sequence
  Description of Artificial Sequence: Synthetic oligonucleotide
ccagggaatgaatggctgcgacatggg

SEQ ID NO: 426203 - DNA, 27 bp, Artificial Sequence
  Description of Artificial Sequence: Synthetic oligonucleotide
cagggaatgaatggctgcgacatgggg

SEQ ID NO: 426204 - DNA, 27 bp, Artificial Sequence
  Description of Artificial Sequence: Synthetic oligonucleotide
agggaatgaatggctgcgacatggggc

SEQ ID NO: 426205 - DNA, 26 bp, Artificial Sequence
  Description of Artificial Sequence: Synthetic oligonucleotide
gggaatgaatggctgcgacatggggc

SEQ ID NO: 426206 - DNA, 26 bp, Artificial Sequence
  Description of Artificial Sequence: Synthetic oligonucleotide
ggaatgaatggctgcgacatggggcc

SEQ ID NO: 426207 - DNA, 26 bp, Artificial Sequence
  Description of Artificial Sequence: Synthetic oligonucleotide
gaatgaatggctgcgacatggggccc

SEQ ID NO: 426208 - DNA, 27 bp, Artificial Sequence
  Description of Artificial Sequence: Synthetic oligonucleotide
aatgaatggctgcgacatggggcccga

SEQ ID NO: 426209 - DNA, 26 bp, Artificial Sequence
  Description of Artificial Sequence: Synthetic oligonucleotide
atgaatggctgcgacatggggcccga

SEQ ID NO: 426210 - DNA, 25 bp, Artificial Sequence
  Description of Artificial Sequence: Synthetic oligonucleotide
tgaatggctgcgacatggggcccga

SEQ ID NO: 426211 - DNA, 24 bp, Artificial Sequence
  Description of Artificial Sequence: Synthetic oligonucleotide
gaatggctgcgacatggggcccga

SEQ ID NO: 426212 - DNA, 24 bp, Artificial Sequence
  Description of Artificial Sequence: Synthetic oligonucleotide
aatggctgcgacatggggcccgac

SEQ ID NO: 426213 - DNA, 23 bp, Artificial Sequence
  Description of Artificial Sequence: Synthetic oligonucleotide
atggctgcgacatggggcccgac

SEQ ID NO: 426214 - DNA, 22 bp, Artificial Sequence
  Description of Artificial Sequence: Synthetic oligonucleotide
tggctgcgacatggggcccgac

SEQ ID NO: 426215 - DNA, 21 bp, Artificial Sequence
  Description of Artificial Sequence: Synthetic oligonucleotide
ggctgcgacatggggcccgac

SEQ ID NO: 426216 - DNA, 21 bp, Artificial Sequence
  Description of Artificial Sequence: Synthetic oligonucleotide
gctgcgacatggggcccgacg

SEQ ID NO: 426217 - DNA, 22 bp, Artificial Sequence
  Description of Artificial Sequence: Synthetic oligonucleotide
ctgcgacatggggcccgacgga

SEQ ID NO: 426218 - DNA, 22 bp, Artificial Sequence
  Description of Artificial Sequence: Synthetic oligonucleotide
tgcgacatggggcccgacggac

SEQ ID NO: 426219 - DNA, 21 bp, Artificial Sequence
  Description of Artificial Sequence: Synthetic oligonucleotide
gcgacatggggcccgacggac

SEQ ID NO: 426220 - DNA, 21 bp, Artificial Sequence
  Description of Artificial Sequence: Synthetic oligonucleotide
cgacatggggcccgacggacg

SEQ ID NO: 426221 - DNA, 21 bp, Artificial Sequence
  Description of Artificial Sequence: Synthetic oligonucleotide
gacatggggcccgacggacgc

SEQ ID NO: 426222 - DNA, 22 bp, Artificial Sequence
  Description of Artificial Sequence: Synthetic oligonucleotide
acatggggcccgacggacgcct

SEQ ID NO: 426223 - DNA, 21 bp, Artificial Sequence
  Description of Artificial Sequence: Synthetic oligonucleotide
catggggcccgacggacgcct

SEQ ID NO: 426224 - DNA, 21 bp, Artificial Sequence
  Description of Artificial Sequence: Synthetic oligonucleotide
atggggcccgacggacgcctc

SEQ ID NO: 426225 - DNA, 23 bp, Artificial Sequence
  Description of Artificial Sequence: Synthetic oligonucleotide
ggacgcctcctccgcgggtatca

SEQ ID NO: 426226 - DNA, 23 bp, Artificial Sequence
  Description of Artificial Sequence: Synthetic oligonucleotide
gacgcctcctccgcgggtatcac

SEQ ID NO: 426227 - DNA, 24 bp, Artificial Sequence
  Description of Artificial Sequence: Synthetic oligonucleotide
acgcctcctccgcgggtatcacca

SEQ ID NO: 426228 - DNA, 23 bp, Artificial Sequence
  Description of Artificial Sequence: Synthetic oligonucleotide
cgcctcctccgcgggtatcacca

SEQ ID NO: 426229 - DNA, 23 bp, Artificial Sequence
  Description of Artificial Sequence: Synthetic oligonucleotide
gcctcctccgcgggtatcaccag

SEQ ID NO: 426230 - DNA, 24 bp, Artificial Sequence
  Description of Artificial Sequence: Synthetic oligonucleotide
cctcctccgcgggtatcaccagca

SEQ ID NO: 426231 - DNA, 24 bp, Artificial Sequence
  Description of Artificial Sequence: Synthetic oligonucleotide
ctcctccgcgggtatcaccagcac

SEQ ID NO: 426232 - DNA, 24 bp, Artificial Sequence
  Description of Artificial Sequence: Synthetic oligonucleotide
tcctccgcgggtatcaccagcacg

SEQ ID NO: 426233 - DNA, 23 bp, Artificial Sequence
  Description of Artificial Sequence: Synthetic oligonucleotide
cctccgcgggtatcaccagcacg

SEQ ID NO: 426234 - DNA, 23 bp, Artificial Sequence
  Description of Artificial Sequence: Synthetic oligonucleotide
ctccgcgggtatcaccagcacgc

SEQ ID NO: 426235 - DNA, 25 bp, Artificial Sequence
  Description of Artificial Sequence: Synthetic oligonucleotide
tccgcgggtatcaccagcacgcgta

SEQ ID NO: 426236 - DNA, 24 bp, Artificial Sequence
  Description of Artificial Sequence: Synthetic oligonucleotide
ccgcgggtatcaccagcacgcgta

SEQ ID NO: 426237 - DNA, 24 bp, Artificial Sequence
  Description of Artificial Sequence: Synthetic oligonucleotide
cgcgggtatcaccagcacgcgtac

SEQ ID NO: 426238 - DNA, 25 bp, Artificial Sequence
  Description of Artificial Sequence: Synthetic oligonucleotide
gcgggtatcaccagcacgcgtacga

SEQ ID NO: 426239 - DNA, 25 bp, Artificial Sequence
  Description of Artificial Sequence: Synthetic oligonucleotide
cgggtatcaccagcacgcgtacgac

SEQ ID NO: 426240 - DNA, 25 bp, Artificial Sequence
  Description of Artificial Sequence: Synthetic oligonucleotide
gggtatcaccagcacgcgtacgacg

SEQ ID NO: 426241 - DNA, 25 bp, Artificial Sequence
  Description of Artificial Sequence: Synthetic oligonucleotide
ggtatcaccagcacgcgtacgacgg

SEQ ID NO: 426242 - DNA, 27 bp, Artificial Sequence
  Description of Artificial Sequence: Synthetic oligonucleotide
gtatcaccagcacgcgtacgacggcaa

SEQ ID NO: 426243 - DNA, 27 bp, Artificial Sequence
  Description of Artificial Sequence: Synthetic oligonucleotide
tatcaccagcacgcgtacgacggcaag

SEQ ID NO: 426244 - DNA, 26 bp, Artificial Sequence
  Description of Artificial Sequence: Synthetic oligonucleotide
atcaccagcacgcgtacgacggcaag

SEQ ID NO: 426245 - DNA, 25 bp, Artificial Sequence
  Description of Artificial Sequence: Synthetic oligonucleotide
tcaccagcacgcgtacgacggcaag

SEQ ID NO: 426246 - DNA, 24 bp, Artificial Sequence
  Description of Artificial Sequence: Synthetic oligonucleotide
caccagcacgcgtacgacggcaag

SEQ ID NO: 426247 - DNA, 27 bp, Artificial Sequence
  Description of Artificial Sequence: Synthetic oligonucleotide
accagcacgcgtacgacggcaaggatt

SEQ ID NO: 426248 - DNA, 27 bp, Artificial Sequence
  Description of Artificial Sequence: Synthetic oligonucleotide
ccagcacgcgtacgacggcaaggatta

SEQ ID NO: 426249 - DNA, 27 bp, Artificial Sequence
  Description of Artificial Sequence: Synthetic oligonucleotide
cagcacgcgtacgacggcaaggattac

SEQ ID NO: 426250 - DNA, 29 bp, Artificial Sequence
  Description of Artificial Sequence: Synthetic oligonucleotide
agcacgcgtacgacggcaaggattacatc

SEQ ID NO: 426251 - DNA, 28 bp, Artificial Sequence
  Description of Artificial Sequence: Synthetic oligonucleotide
gcacgcgtacgacggcaaggattacatc

SEQ ID NO: 426252 - DNA, 29 bp, Artificial Sequence
  Description of Artificial Sequence: Synthetic oligonucleotide
cacgcgtacgacggcaaggattacatctc

SEQ ID NO: 426253 - DNA, 29 bp, Artificial Sequence
  Description of Artificial Sequence: Synthetic oligonucleotide
acgcgtacgacggcaaggattacatctcc

SEQ ID NO: 426254 - DNA, 28 bp, Artificial Sequence
  Description of Artificial Sequence: Synthetic oligonucleotide
cgcgtacgacggcaaggattacatctcc

SEQ ID NO: 426255 - DNA, 28 bp, Artificial Sequence
  Description of Artificial Sequence: Synthetic oligonucleotide
gcgtacgacggcaaggattacatctccc

SEQ ID NO: 426256 - DNA, 29 bp, Artificial Sequence
  Description of Artificial Sequence: Synthetic oligonucleotide
cgtacgacggcaaggattacatctccctg

SEQ ID NO: 426257 - DNA, 31 bp, Artificial Sequence; identical to SEQ ID NO: 76794
  Description of Artificial Sequence: Synthetic oligonucleotide

SEQ ID NO: 426258 - DNA, 26 bp, Artificial Sequence
  Description of Artificial Sequence: Synthetic oligonucleotide
atctccctgaacgaggacctgcgctc

SEQ ID NO: 426259 - DNA, 25 bp, Artificial Sequence
  Description of Artificial Sequence: Synthetic oligonucleotide
tctccctgaacgaggacctgcgctc

SEQ ID NO: 426260 - DNA, 24 bp, Artificial Sequence
  Description of Artificial Sequence: Synthetic oligonucleotide
ctccctgaacgaggacctgcgctc

SEQ ID NO: 426261 - DNA, 25 bp, Artificial Sequence
  Description of Artificial Sequence: Synthetic oligonucleotide
tccctgaacgaggacctgcgctcct

SEQ ID NO: 426262 - DNA, 21 bp, Artificial Sequence
  Description of Artificial Sequence: Synthetic oligonucleotide
ctggaccgcggcggacaccgt

SEQ ID NO: 426263 - DNA, 21 bp, Artificial Sequence
  Description of Artificial Sequence: Synthetic oligonucleotide
tggaccgcggcggacaccgtg

SEQ ID NO: 426264 - DNA, 20 bp, Artificial Sequence
  Description of Artificial Sequence: Synthetic oligonucleotide
ggaccgcggcggacaccgtg

SEQ ID NO: 426265 - DNA, 20 bp, Artificial Sequence
  Description of Artificial Sequence: Synthetic oligonucleotide
gaccgcggcggacaccgtgg

SEQ ID NO: 426266 - DNA, 21 bp, Artificial Sequence
  Description of Artificial Sequence: Synthetic oligonucleotide
accgcggcggacaccgtggct

SEQ ID NO: 426267 - DNA, 20 bp, Artificial Sequence
  Description of Artificial Sequence: Synthetic oligonucleotide
ccgcggcggacaccgtggct

SEQ ID NO: 426268 - DNA, 21 bp, Artificial Sequence
  Description of Artificial Sequence: Synthetic oligonucleotide
cgcggcggacaccgtggctca

SEQ ID NO: 426269 - DNA, 23 bp, Artificial Sequence
  Description of Artificial Sequence: Synthetic oligonucleotide
gcggcggacaccgtggctcagat

SEQ ID NO: 426270 - DNA, 24 bp, Artificial Sequence
  Description of Artificial Sequence: Synthetic oligonucleotide
cggcggacaccgtggctcagatca

SEQ ID NO: 426271 - DNA, 24 bp, Artificial Sequence
  Description of Artificial Sequence: Synthetic oligonucleotide
ggcggacaccgtggctcagatcac

SEQ ID NO: 426272 - DNA, 24 bp, Artificial Sequence
  Description of Artificial Sequence: Synthetic oligonucleotide
gcggacaccgtggctcagatcacc

SEQ ID NO: 426273 - DNA, 25 bp, Artificial Sequence
  Description of Artificial Sequence: Synthetic oligonucleotide
cggacaccgtggctcagatcaccca

SEQ ID NO: 426274 - DNA, 25 bp, Artificial Sequence
  Description of Artificial Sequence: Synthetic oligonucleotide
ggacaccgtggctcagatcacccag

SEQ ID NO: 426275 - DNA, 25 bp, Artificial Sequence
  Description of Artificial Sequence: Synthetic oligonucleotide
gacaccgtggctcagatcacccagc

SEQ ID NO: 426276 - DNA, 25 bp, Artificial Sequence
  Description of Artificial Sequence: Synthetic oligonucleotide
acaccgtggctcagatcacccagcg

SEQ ID NO: 426277 - DNA, 24 bp, Artificial Sequence
  Description of Artificial Sequence: Synthetic oligonucleotide
caccgtggctcagatcacccagcg

SEQ ID NO: 426278 - DNA, 26 bp, Artificial Sequence
  Description of Artificial Sequence: Synthetic oligonucleotide
accgtggctcagatcacccagcgctt

SEQ ID NO: 426279 - DNA, 25 bp, Artificial Sequence
  Description of Artificial Sequence: Synthetic oligonucleotide
ccgtggctcagatcacccagcgctt

SEQ ID NO: 426280 - DNA, 27 bp, Artificial Sequence
  Description of Artificial Sequence: Synthetic oligonucleotide
cgtggctcagatcacccagcgcttcta

SEQ ID NO: 426281 - DNA, 28 bp, Artificial Sequence
  Description of Artificial Sequence: Synthetic oligonucleotide
gtggctcagatcacccagcgcttctatg

SEQ ID NO: 426282 - DNA, 29 bp, Artificial Sequence
  Description of Artificial Sequence: Synthetic oligonucleotide
tggctcagatcacccagcgcttctatgag

SEQ ID NO: 426283 - DNA, 28 bp, Artificial Sequence
  Description of Artificial Sequence: Synthetic oligonucleotide
ggctcagatcacccagcgcttctatgag

SEQ ID NO: 426284 - DNA, 28 bp, Artificial Sequence
  Description of Artificial Sequence: Synthetic oligonucleotide
gctcagatcacccagcgcttctatgagg

SEQ ID NO: 426285 - DNA, 28 bp, Artificial Sequence
  Description of Artificial Sequence: Synthetic oligonucleotide
ctcagatcacccagcgcttctatgaggc

SEQ ID NO: 426286 - DNA, 29 bp, Artificial Sequence
  Description of Artificial Sequence: Synthetic oligonucleotide
tcagatcacccagcgcttctatgaggcag

SEQ ID NO: 426287 - DNA, 28 bp, Artificial Sequence
  Description of Artificial Sequence: Synthetic oligonucleotide
cagatcacccagcgcttctatgaggcag

SEQ ID NO: 426288 - DNA, 29 bp, Artificial Sequence
  Description of Artificial Sequence: Synthetic oligonucleotide
agatcacccagcgcttctatgaggcagag

SEQ ID NO: 426289 - DNA, 28 bp, Artificial Sequence
  Description of Artificial Sequence: Synthetic oligonucleotide
gatcacccagcgcttctatgaggcagag

SEQ ID NO: 426290 - DNA, 28 bp, Artificial Sequence
  Description of Artificial Sequence: Synthetic oligonucleotide
atcacccagcgcttctatgaggcagagg

SEQ ID NO: 426291 - DNA, 27 bp, Artificial Sequence
  Description of Artificial Sequence: Synthetic oligonucleotide
tcacccagcgcttctatgaggcagagg

SEQ ID NO: 426292 - DNA, 27 bp, Artificial Sequence
  Description of Artificial Sequence: Synthetic oligonucleotide
cacccagcgcttctatgaggcagagga

SEQ ID NO: 426293 - DNA, 31 bp, Artificial Sequence; identical to SEQ ID NO: 76824
  Description of Artificial Sequence: Synthetic oligonucleotide

SEQ ID NO: 426294 - DNA, 30 bp, Artificial Sequence; identical to SEQ ID NO: 76825
  Description of Artificial Sequence: Synthetic oligonucleotide

SEQ ID NO: 426295 - DNA, 30 bp, Artificial Sequence; identical to SEQ ID NO: 76826
  Description of Artificial Sequence: Synthetic oligonucleotide

SEQ ID NO: 426296 - DNA, 31 bp, Artificial Sequence; identical to SEQ ID NO: 76827
  Description of Artificial Sequence: Synthetic oligonucleotide

SEQ ID NO: 426297 - DNA, 32 bp, Artificial Sequence; identical to SEQ ID NO: 76828
  Description of Artificial Sequence: Synthetic oligonucleotide

SEQ ID NO: 426298 - DNA, 31 bp, Artificial Sequence; identical to SEQ ID NO: 76829
  Description of Artificial Sequence: Synthetic oligonucleotide

SEQ ID NO: 426299 - DNA, 31 bp, Artificial Sequence; identical to SEQ ID NO: 76830
  Description of Artificial Sequence: Synthetic oligonucleotide

SEQ ID NO: 426300 - DNA, 32 bp, Artificial Sequence; identical to SEQ ID NO: 76831
  Description of Artificial Sequence: Synthetic oligonucleotide

SEQ ID NO: 426301 - DNA, 34 bp, Artificial Sequence; identical to SEQ ID NO: 76832
  Description of Artificial Sequence: Synthetic oligonucleotide

SEQ ID NO: 426302 - DNA, 35 bp, Artificial Sequence; identical to SEQ ID NO: 76833
  Description of Artificial Sequence: Synthetic oligonucleotide

SEQ ID NO: 426303 - DNA, 34 bp, Artificial Sequence; identical to SEQ ID NO: 76834
  Description of Artificial Sequence: Synthetic oligonucleotide

SEQ ID NO: 426304 - DNA, 33 bp, Artificial Sequence; identical to SEQ ID NO: 76835
  Description of Artificial Sequence: Synthetic oligonucleotide

SEQ ID NO: 426305 - DNA, 33 bp, Artificial Sequence; identical to SEQ ID NO: 76836
  Description of Artificial Sequence: Synthetic oligonucleotide

SEQ ID NO: 426306 - DNA, 32 bp, Artificial Sequence; identical to SEQ ID NO: 76837
  Description of Artificial Sequence: Synthetic oligonucleotide

SEQ ID NO: 426307 - DNA, 31 bp, Artificial Sequence; identical to SEQ ID NO: 76838
  Description of Artificial Sequence: Synthetic oligonucleotide

SEQ ID NO: 426308 - DNA, 30 bp, Artificial Sequence; identical to SEQ ID NO: 76839
  Description of Artificial Sequence: Synthetic oligonucleotide

SEQ ID NO: 426309 - DNA, 31 bp, Artificial Sequence; identical to SEQ ID NO: 76840
  Description of Artificial Sequence: Synthetic oligonucleotide

SEQ ID NO: 426310 - DNA, 30 bp, Artificial Sequence; identical to SEQ ID NO: 76841
  Description of Artificial Sequence: Synthetic oligonucleotide

SEQ ID NO: 426311 - DNA, 30 bp, Artificial Sequence; identical to SEQ ID NO: 76842
  Description of Artificial Sequence: Synthetic oligonucleotide

SEQ ID NO: 426312 - DNA, 32 bp, Artificial Sequence; identical to SEQ ID NO: 76843
  Description of Artificial Sequence: Synthetic oligonucleotide

SEQ ID NO: 426313 - DNA, 32 bp, Artificial Sequence; identical to SEQ ID NO: 76844
  Description of Artificial Sequence: Synthetic oligonucleotide

SEQ ID NO: 426314 - DNA, 31 bp, Artificial Sequence; identical to SEQ ID NO: 76845
  Description of Artificial Sequence: Synthetic oligonucleotide

SEQ ID NO: 426315 - DNA, 32 bp, Artificial Sequence; identical to SEQ ID NO: 76846
  Description of Artificial Sequence: Synthetic oligonucleotide

SEQ ID NO: 426316 - DNA, 31 bp, Artificial Sequence; identical to SEQ ID NO: 76847
  Description of Artificial Sequence: Synthetic oligonucleotide

SEQ ID NO: 426317 - DNA, 31 bp, Artificial Sequence; identical to SEQ ID NO: 76848
  Description of Artificial Sequence: Synthetic oligonucleotide

SEQ ID NO: 426318 - DNA, 32 bp, Artificial Sequence; identical to SEQ ID NO: 76849
  Description of Artificial Sequence: Synthetic oligonucleotide

SEQ ID NO: 426319 - DNA, 31 bp, Artificial Sequence; identical to SEQ ID NO: 76850
  Description of Artificial Sequence: Synthetic oligonucleotide

SEQ ID NO: 426320 - DNA, 30 bp, Artificial Sequence; identical to SEQ ID NO: 76851
  Description of Artificial Sequence: Synthetic oligonucleotide

SEQ ID NO: 426321 - DNA, 29 bp, Artificial Sequence
  Description of Artificial Sequence: Synthetic oligonucleotide
atgcagaggagttcaggacctacctggag

SEQ ID NO: 426322 - DNA, 28 bp, Artificial Sequence
  Description of Artificial Sequence: Synthetic oligonucleotide
tgcagaggagttcaggacctacctggag

SEQ ID NO: 426323 - DNA, 27 bp, Artificial Sequence
  Description of Artificial Sequence: Synthetic oligonucleotide
gcagaggagttcaggacctacctggag

SEQ ID NO: 426324 - DNA, 27 bp, Artificial Sequence
  Description of Artificial Sequence: Synthetic oligonucleotide
cagaggagttcaggacctacctggagg

SEQ ID NO: 426325 - DNA, 27 bp, Artificial Sequence
  Description of Artificial Sequence: Synthetic oligonucleotide
agaggagttcaggacctacctggaggg

SEQ ID NO: 426326 - DNA, 26 bp, Artificial Sequence
  Description of Artificial Sequence: Synthetic oligonucleotide
gaggagttcaggacctacctggaggg

SEQ ID NO: 426327 - DNA, 26 bp, Artificial Sequence
  Description of Artificial Sequence: Synthetic oligonucleotide
aggagttcaggacctacctggagggc

SEQ ID NO: 426328 - DNA, 25 bp, Artificial Sequence
  Description of Artificial Sequence: Synthetic oligonucleotide
ggagttcaggacctacctggagggc

SEQ ID NO: 426329 - DNA, 26 bp, Artificial Sequence
  Description of Artificial Sequence: Synthetic oligonucleotide
gagttcaggacctacctggagggcga

SEQ ID NO: 426330 - DNA, 27 bp, Artificial Sequence
  Description of Artificial Sequence: Synthetic oligonucleotide
agttcaggacctacctggagggcgagt

SEQ ID NO: 426331 - DNA, 26 bp, Artificial Sequence
  Description of Artificial Sequence: Synthetic oligonucleotide
gttcaggacctacctggagggcgagt

SEQ ID NO: 426332 - DNA, 26 bp, Artificial Sequence
  Description of Artificial Sequence: Synthetic oligonucleotide
ttcaggacctacctggagggcgagtg

SEQ ID NO: 426333 - DNA, 25 bp, Artificial Sequence
  Description of Artificial Sequence: Synthetic oligonucleotide
tcaggacctacctggagggcgagtg

SEQ ID NO: 426334 - DNA, 24 bp, Artificial Sequence
  Description of Artificial Sequence: Synthetic oligonucleotide
caggacctacctggagggcgagtg

SEQ ID NO: 426335 - DNA, 24 bp, Artificial Sequence
  Description of Artificial Sequence: Synthetic oligonucleotide
aggacctacctggagggcgagtgc

SEQ ID NO: 426336 - DNA, 23 bp, Artificial Sequence
  Description of Artificial Sequence: Synthetic oligonucleotide
ggacctacctggagggcgagtgc

SEQ ID NO: 426337 - DNA, 24 bp, Artificial Sequence
  Description of Artificial Sequence: Synthetic oligonucleotide
gacctacctggagggcgagtgcct

SEQ ID NO: 426338 - DNA, 24 bp, Artificial Sequence
  Description of Artificial Sequence: Synthetic oligonucleotide
acctacctggagggcgagtgcctg

SEQ ID NO: 426339 - DNA, 23 bp, Artificial Sequence
  Description of Artificial Sequence: Synthetic oligonucleotide
cctacctggagggcgagtgcctg

SEQ ID NO: 426340 - DNA, 24 bp, Artificial Sequence
  Description of Artificial Sequence: Synthetic oligonucleotide
ctacctggagggcgagtgcctgga

SEQ ID NO: 426341 - DNA, 26 bp, Artificial Sequence
  Description of Artificial Sequence: Synthetic oligonucleotide
tacctggagggcgagtgcctggagtt

SEQ ID NO: 426342 - DNA, 25 bp, Artificial Sequence
  Description of Artificial Sequence: Synthetic oligonucleotide
acctggagggcgagtgcctggagtt

SEQ ID NO: 426343 - DNA, 24 bp, Artificial Sequence
  Description of Artificial Sequence: Synthetic oligonucleotide
cctggagggcgagtgcctggagtt

SEQ ID NO: 426344 - DNA, 24 bp, Artificial Sequence
  Description of Artificial Sequence: Synthetic oligonucleotide
ctggagggcgagtgcctggagttg

SEQ ID NO: 426345 - DNA, 25 bp, Artificial Sequence
  Description of Artificial Sequence: Synthetic oligonucleotide
tggagggcgagtgcctggagttgct

SEQ ID NO: 426346 - DNA, 24 bp, Artificial Sequence
  Description of Artificial Sequence: Synthetic oligonucleotide
ggagggcgagtgcctggagttgct

SEQ ID NO: 426347 - DNA, 24 bp, Artificial Sequence
  Description of Artificial Sequence: Synthetic oligonucleotide
gagggcgagtgcctggagttgctc

SEQ ID NO: 426348 - DNA, 24 bp, Artificial Sequence
  Description of Artificial Sequence: Synthetic oligonucleotide
agggcgagtgcctggagttgctcc

SEQ ID NO: 426349 - DNA, 23 bp, Artificial Sequence
  Description of Artificial Sequence: Synthetic oligonucleotide
gggcgagtgcctggagttgctcc

SEQ ID NO: 426350 - DNA, 23 bp, Artificial Sequence
  Description of Artificial Sequence: Synthetic oligonucleotide
ggcgagtgcctggagttgctccg

SEQ ID NO: 426351 - DNA, 24 bp, Artificial Sequence
  Description of Artificial Sequence: Synthetic oligonucleotide
gcgagtgcctggagttgctccgca

SEQ ID NO: 426352 - DNA, 27 bp, Artificial Sequence
  Description of Artificial Sequence: Synthetic oligonucleotide
cgagtgcctggagttgctccgcagata

SEQ ID NO: 426353 - DNA, 27 bp, Artificial Sequence
  Description of Artificial Sequence: Synthetic oligonucleotide
gagtgcctggagttgctccgcagatac

SEQ ID NO: 426354 - DNA, 29 bp, Artificial Sequence
  Description of Artificial Sequence: Synthetic oligonucleotide
agtgcctggagttgctccgcagatacttg

SEQ ID NO: 426355 - DNA, 28 bp, Artificial Sequence
  Description of Artificial Sequence: Synthetic oligonucleotide
gtgcctggagttgctccgcagatacttg

SEQ ID NO: 426356 - DNA, 28 bp, Artificial Sequence
  Description of Artificial Sequence: Synthetic oligonucleotide
tgcctggagttgctccgcagatacttgg

SEQ ID NO: 426357 - DNA, 27 bp, Artificial Sequence
  Description of Artificial Sequence: Synthetic oligonucleotide
gcctggagttgctccgcagatacttgg

SEQ ID NO: 426358 - DNA, 28 bp, Artificial Sequence
  Description of Artificial Sequence: Synthetic oligonucleotide
cctggagttgctccgcagatacttggag

SEQ ID NO: 426359 - DNA, 31 bp, Artificial Sequence; identical to SEQ ID NO: 76890
  Description of Artificial Sequence: Synthetic oligonucleotide

SEQ ID NO: 426360 - DNA, 31 bp, Artificial Sequence; identical to SEQ ID NO: 76891
  Description of Artificial Sequence: Synthetic oligonucleotide

SEQ ID NO: 426361 - DNA, 30 bp, Artificial Sequence; identical to SEQ ID NO: 76892
  Description of Artificial Sequence: Synthetic oligonucleotide

SEQ ID NO: 426362 - DNA, 30 bp, Artificial Sequence; identical to SEQ ID NO: 76893
  Description of Artificial Sequence: Synthetic oligonucleotide

SEQ ID NO: 426363 - DNA, 32 bp, Artificial Sequence; identical to SEQ ID NO: 76894
  Description of Artificial Sequence: Synthetic oligonucleotide

SEQ ID NO: 426364 - DNA, 31 bp, Artificial Sequence; identical to SEQ ID NO: 76895
  Description of Artificial Sequence: Synthetic oligonucleotide

SEQ ID NO: 426365 - DNA, 31 bp, Artificial Sequence; identical to SEQ ID NO: 76896
  Description of Artificial Sequence: Synthetic oligonucleotide

SEQ ID NO: 426366 - DNA, 30 bp, Artificial Sequence; identical to SEQ ID NO: 76897
  Description of Artificial Sequence: Synthetic oligonucleotide

SEQ ID NO: 426367 - DNA, 29 bp, Artificial Sequence
  Description of Artificial Sequence: Synthetic oligonucleotide
gctccgcagatacttggagaatgggaagg

SEQ ID NO: 426368 - DNA, 30 bp, Artificial Sequence; identical to SEQ ID NO: 76899
  Description of Artificial Sequence: Synthetic oligonucleotide

SEQ ID NO: 426369 - DNA, 31 bp, Artificial Sequence; identical to SEQ ID NO: 76900
  Description of Artificial Sequence: Synthetic oligonucleotide

SEQ ID NO: 426370 - DNA, 30 bp, Artificial Sequence; identical to SEQ ID NO: 76901
  Description of Artificial Sequence: Synthetic oligonucleotide

SEQ ID NO: 426371 - DNA, 30 bp, Artificial Sequence; identical to SEQ ID NO: 76902
  Description of Artificial Sequence: Synthetic oligonucleotide

SEQ ID NO: 426372 - DNA, 30 bp, Artificial Sequence; identical to SEQ ID NO: 76903
  Description of Artificial Sequence: Synthetic oligonucleotide

SEQ ID NO: 426373 - DNA, 32 bp, Artificial Sequence; identical to SEQ ID NO: 76904
  Description of Artificial Sequence: Synthetic oligonucleotide

SEQ ID NO: 426374 - DNA, 33 bp, Artificial Sequence; identical to SEQ ID NO: 76905
  Description of Artificial Sequence: Synthetic oligonucleotide

SEQ ID NO: 426375 - DNA, 32 bp, Artificial Sequence; identical to SEQ ID NO: 76906
  Description of Artificial Sequence: Synthetic oligonucleotide

SEQ ID NO: 426376 - DNA, 32 bp, Artificial Sequence; identical to SEQ ID NO: 76907
  Description of Artificial Sequence: Synthetic oligonucleotide

SEQ ID NO: 426377 - DNA, 31 bp, Artificial Sequence; identical to SEQ ID NO: 76908
  Description of Artificial Sequence: Synthetic oligonucleotide

SEQ ID NO: 426378 - DNA, 30 bp, Artificial Sequence; identical to SEQ ID NO: 76909
  Description of Artificial Sequence: Synthetic oligonucleotide

SEQ ID NO: 426379 - DNA, 29 bp, Artificial Sequence
  Description of Artificial Sequence: Synthetic oligonucleotide
cttggagaatgggaaggagacgctacagc

SEQ ID NO: 426380 - DNA, 29 bp, Artificial Sequence
  Description of Artificial Sequence: Synthetic oligonucleotide
ttggagaatgggaaggagacgctacagcg

SEQ ID NO: 426381 - DNA, 28 bp, Artificial Sequence
  Description of Artificial Sequence: Synthetic oligonucleotide
tggagaatgggaaggagacgctacagcg

SEQ ID NO: 426382 - DNA, 27 bp, Artificial Sequence
  Description of Artificial Sequence: Synthetic oligonucleotide
ggagaatgggaaggagacgctacagcg

SEQ ID NO: 426383 - DNA, 27 bp, Artificial Sequence
  Description of Artificial Sequence: Synthetic oligonucleotide
gagaatgggaaggagacgctacagcgc

SEQ ID NO: 426384 - DNA, 27 bp, Artificial Sequence
  Description of Artificial Sequence: Synthetic oligonucleotide
agaatgggaaggagacgctacagcgcg

SEQ ID NO: 426385 - DNA, 26 bp, Artificial Sequence
  Description of Artificial Sequence: Synthetic oligonucleotide
gaatgggaaggagacgctacagcgcg

SEQ ID NO: 426386 - DNA, 27 bp, Artificial Sequence
  Description of Artificial Sequence: Synthetic oligonucleotide
aatgggaaggagacgctacagcgcgca

SEQ ID NO: 426387 - DNA, 26 bp, Artificial Sequence
  Description of Artificial Sequence: Synthetic oligonucleotide
atgggaaggagacgctacagcgcgca

SEQ ID NO: 426388 - DNA, 25 bp, Artificial Sequence
  Description of Artificial Sequence: Synthetic oligonucleotide
tgggaaggagacgctacagcgcgca

SEQ ID NO: 426389 - DNA, 24 bp, Artificial Sequence
  Description of Artificial Sequence: Synthetic oligonucleotide
gggaaggagacgctacagcgcgca

SEQ ID NO: 426390 - DNA, 26 bp, Artificial Sequence
  Description of Artificial Sequence: Synthetic oligonucleotide
ggaaggagacgctacagcgcgcagat

SEQ ID NO: 426391 - DNA, 26 bp, Artificial Sequence
  Description of Artificial Sequence: Synthetic oligonucleotide
gaaggagacgctacagcgcgcagatc

SEQ ID NO: 426392 - DNA, 27 bp, Artificial Sequence
  Description of Artificial Sequence: Synthetic oligonucleotide
aaggagacgctacagcgcgcagatcct

SEQ ID NO: 426393 - DNA, 26 bp, Artificial Sequence
  Description of Artificial Sequence: Synthetic oligonucleotide
aggagacgctacagcgcgcagatcct

SEQ ID NO: 426394 - DNA, 25 bp, Artificial Sequence
  Description of Artificial Sequence: Synthetic oligonucleotide
ggagacgctacagcgcgcagatcct

SEQ ID NO: 426395 - DNA, 25 bp, Artificial Sequence
  Description of Artificial Sequence: Synthetic oligonucleotide
gagacgctacagcgcgcagatcctc

SEQ ID NO: 426396 - DNA, 27 bp, Artificial Sequence
  Description of Artificial Sequence: Synthetic oligonucleotide
agacgctacagcgcgcagatcctccaa

SEQ ID NO: 426397 - DNA, 27 bp, Artificial Sequence
  Description of Artificial Sequence: Synthetic oligonucleotide
gacgctacagcgcgcagatcctccaaa

SEQ ID NO: 426398 - DNA, 27 bp, Artificial Sequence
  Description of Artificial Sequence: Synthetic oligonucleotide
acgctacagcgcgcagatcctccaaag

SEQ ID NO: 426399 - DNA, 26 bp, Artificial Sequence
  Description of Artificial Sequence: Synthetic oligonucleotide
cgctacagcgcgcagatcctccaaag

SEQ ID NO: 426400 - DNA, 26 bp, Artificial Sequence
  Description of Artificial Sequence: Synthetic oligonucleotide
gctacagcgcgcagatcctccaaagg

SEQ ID NO: 426401 - DNA, 27 bp, Artificial Sequence
  Description of Artificial Sequence: Synthetic oligonucleotide
ctacagcgcgcagatcctccaaaggca

SEQ ID NO: 426402 - DNA, 27 bp, Artificial Sequence
  Description of Artificial Sequence: Synthetic oligonucleotide
tacagcgcgcagatcctccaaaggcac

SEQ ID NO: 426403 - DNA, 27 bp, Artificial Sequence
  Description of Artificial Sequence: Synthetic oligonucleotide
acagcgcgcagatcctccaaaggcaca

SEQ ID NO: 426404 - DNA, 26 bp, Artificial Sequence
  Description of Artificial Sequence: Synthetic oligonucleotide
cagcgcgcagatcctccaaaggcaca

SEQ ID NO: 426405 - DNA, 26 bp, Artificial Sequence
  Description of Artificial Sequence: Synthetic oligonucleotide
agcgcgcagatcctccaaaggcacac

SEQ ID NO: 426406 - DNA, 25 bp, Artificial Sequence
  Description of Artificial Sequence: Synthetic oligonucleotide
gcgcgcagatcctccaaaggcacac

SEQ ID NO: 426407 - DNA, 27 bp, Artificial Sequence
  Description of Artificial Sequence: Synthetic oligonucleotide
cgcgcagatcctccaaaggcacacgtt

SEQ ID NO: 426408 - DNA, 27 bp, Artificial Sequence
  Description of Artificial Sequence: Synthetic oligonucleotide
gcgcagatcctccaaaggcacacgttg

SEQ ID NO: 426409 - DNA, 27 bp, Artificial Sequence
  Description of Artificial Sequence: Synthetic oligonucleotide
cgcagatcctccaaaggcacacgttgc

SEQ ID NO: 426410 - DNA, 27 bp, Artificial Sequence
  Description of Artificial Sequence: Synthetic oligonucleotide
gcagatcctccaaaggcacacgttgcc

SEQ ID NO: 426411 - DNA, 27 bp, Artificial Sequence
  Description of Artificial Sequence: Synthetic oligonucleotide
cagatcctccaaaggcacacgttgccc

SEQ ID NO: 426412 - DNA, 28 bp, Artificial Sequence
  Description of Artificial Sequence: Synthetic oligonucleotide
agatcctccaaaggcacacgttgcccac

SEQ ID NO: 426413 - DNA, 27 bp, Artificial Sequence
  Description of Artificial Sequence: Synthetic oligonucleotide
gatcctccaaaggcacacgttgcccac

SEQ ID NO: 426414 - DNA, 27 bp, Artificial Sequence
  Description of Artificial Sequence: Synthetic oligonucleotide
atcctccaaaggcacacgttgcccacc

SEQ ID NO: 426415 - DNA, 27 bp, Artificial Sequence
  Description of Artificial Sequence: Synthetic oligonucleotide
tcctccaaaggcacacgttgcccacca

SEQ ID NO: 426416 - DNA, 26 bp, Artificial Sequence
  Description of Artificial Sequence: Synthetic oligonucleotide
cctccaaaggcacacgttgcccacca

SEQ ID NO: 426417 - DNA, 26 bp, Artificial Sequence
  Description of Artificial Sequence: Synthetic oligonucleotide
ctccaaaggcacacgttgcccaccac

SEQ ID NO: 426418 - DNA, 26 bp, Artificial Sequence
  Description of Artificial Sequence: Synthetic oligonucleotide
tccaaaggcacacgttgcccaccacc

SEQ ID NO: 426419 - DNA, 25 bp, Artificial Sequence
  Description of Artificial Sequence: Synthetic oligonucleotide
ccaaaggcacacgttgcccaccacc

SEQ ID NO: 426420 - DNA, 25 bp, Artificial Sequence
  Description of Artificial Sequence: Synthetic oligonucleotide
caaaggcacacgttgcccaccaccc

SEQ ID NO: 426421 - DNA, 27 bp, Artificial Sequence
  Description of Artificial Sequence: Synthetic oligonucleotide
aaaggcacacgttgcccaccaccccat

SEQ ID NO: 426422 - DNA, 26 bp, Artificial Sequence
  Description of Artificial Sequence: Synthetic oligonucleotide
aaggcacacgttgcccaccaccccat

SEQ ID NO: 426423 - DNA, 25 bp, Artificial Sequence
  Description of Artificial Sequence: Synthetic oligonucleotide
aggcacacgttgcccaccaccccat

SEQ ID NO: 426424 - DNA, 24 bp, Artificial Sequence
  Description of Artificial Sequence: Synthetic oligonucleotide
ggcacacgttgcccaccaccccat

SEQ ID NO: 426425 - DNA, 25 bp, Artificial Sequence
  Description of Artificial Sequence: Synthetic oligonucleotide
gcacacgttgcccaccaccccatct

SEQ ID NO: 426426 - DNA, 26 bp, Artificial Sequence
  Description of Artificial Sequence: Synthetic oligonucleotide
cacacgttgcccaccaccccatctct

SEQ ID NO: 426427 - DNA, 27 bp, Artificial Sequence
  Description of Artificial Sequence: Synthetic oligonucleotide
acacgttgcccaccaccccatctctga

SEQ ID NO: 426428 - DNA, 26 bp, Artificial Sequence
  Description of Artificial Sequence: Synthetic oligonucleotide
cacgttgcccaccaccccatctctga

SEQ ID NO: 426429 - DNA, 26 bp, Artificial Sequence
  Description of Artificial Sequence: Synthetic oligonucleotide
acgttgcccaccaccccatctctgac

SEQ ID NO: 426430 - DNA, 25 bp, Artificial Sequence
  Description of Artificial Sequence: Synthetic oligonucleotide
cgttgcccaccaccccatctctgac

SEQ ID NO: 426431 - DNA, 27 bp, Artificial Sequence
  Description of Artificial Sequence: Synthetic oligonucleotide
gttgcccaccaccccatctctgaccat

SEQ ID NO: 426432 - DNA, 27 bp, Artificial Sequence
  Description of Artificial Sequence: Synthetic oligonucleotide
ttgcccaccaccccatctctgaccatg

SEQ ID NO: 426433 - DNA, 27 bp, Artificial Sequence
  Description of Artificial Sequence: Synthetic oligonucleotide
tgcccaccaccccatctctgaccatga

SEQ ID NO: 426434 - DNA, 26 bp, Artificial Sequence
  Description of Artificial Sequence: Synthetic oligonucleotide
gcccaccaccccatctctgaccatga

SEQ ID NO: 426435 - DNA, 26 bp, Artificial Sequence
  Description of Artificial Sequence: Synthetic oligonucleotide
ctgggcttctaccctgcggagatcac

SEQ ID NO: 426436 - DNA, 26 bp, Artificial Sequence
  Description of Artificial Sequence: Synthetic oligonucleotide
tgggcttctaccctgcggagatcacg

SEQ ID NO: 426437 - DNA, 25 bp, Artificial Sequence
  Description of Artificial Sequence: Synthetic oligonucleotide
gggcttctaccctgcggagatcacg

SEQ ID NO: 426438 - DNA, 26 bp, Artificial Sequence
  Description of Artificial Sequence: Synthetic oligonucleotide
ggcttctaccctgcggagatcacgct

SEQ ID NO: 426439 - DNA, 27 bp, Artificial Sequence
  Description of Artificial Sequence: Synthetic oligonucleotide
gcttctaccctgcggagatcacgctga

SEQ ID NO: 426440 - DNA, 27 bp, Artificial Sequence
  Description of Artificial Sequence: Synthetic oligonucleotide
cttctaccctgcggagatcacgctgac

SEQ ID NO: 426441 - DNA, 27 bp, Artificial Sequence
  Description of Artificial Sequence: Synthetic oligonucleotide
ttctaccctgcggagatcacgctgacc

SEQ ID NO: 426442 - DNA, 27 bp, Artificial Sequence
  Description of Artificial Sequence: Synthetic oligonucleotide
tctaccctgcggagatcacgctgacct

SEQ ID NO: 426443 - DNA, 26 bp, Artificial Sequence
  Description of Artificial Sequence: Synthetic oligonucleotide
ctaccctgcggagatcacgctgacct

SEQ ID NO: 426444 - DNA, 26 bp, Artificial Sequence
  Description of Artificial Sequence: Synthetic oligonucleotide
taccctgcggagatcacgctgacctg

SEQ ID NO: 426445 - DNA, 25 bp, Artificial Sequence
  Description of Artificial Sequence: Synthetic oligonucleotide
accctgcggagatcacgctgacctg

SEQ ID NO: 426446 - DNA, 24 bp, Artificial Sequence
  Description of Artificial Sequence: Synthetic oligonucleotide
ccctgcggagatcacgctgacctg

SEQ ID NO: 426447 - DNA, 24 bp, Artificial Sequence
  Description of Artificial Sequence: Synthetic oligonucleotide
cctgcggagatcacgctgacctgg

SEQ ID NO: 426448 - DNA, 25 bp, Artificial Sequence
  Description of Artificial Sequence: Synthetic oligonucleotide
ctgcggagatcacgctgacctggca

SEQ ID NO: 426449 - DNA, 25 bp, Artificial Sequence
  Description of Artificial Sequence: Synthetic oligonucleotide
tgcggagatcacgctgacctggcag

SEQ ID NO: 426450 - DNA, 24 bp, Artificial Sequence
  Description of Artificial Sequence: Synthetic oligonucleotide
gcggagatcacgctgacctggcag

SEQ ID NO: 426451 - DNA, 24 bp, Artificial Sequence
  Description of Artificial Sequence: Synthetic oligonucleotide
cggagatcacgctgacctggcagc

SEQ ID NO: 426452 - DNA, 24 bp, Artificial Sequence
  Description of Artificial Sequence: Synthetic oligonucleotide
ggagatcacgctgacctggcagcg

SEQ ID NO: 426453 - DNA, 24 bp, Artificial Sequence
  Description of Artificial Sequence: Synthetic oligonucleotide
gagatcacgctgacctggcagcgg

SEQ ID NO: 426454 - DNA, 26 bp, Artificial Sequence
  Description of Artificial Sequence: Synthetic oligonucleotide
agatcacgctgacctggcagcgggat

SEQ ID NO: 426455 - DNA, 25 bp, Artificial Sequence
  Description of Artificial Sequence: Synthetic oligonucleotide
gatcacgctgacctggcagcgggat

SEQ ID NO: 426456 - DNA, 25 bp, Artificial Sequence
  Description of Artificial Sequence: Synthetic oligonucleotide
atcacgctgacctggcagcgggatg

SEQ ID NO: 426457 - DNA, 24 bp, Artificial Sequence
  Description of Artificial Sequence: Synthetic oligonucleotide
tcacgctgacctggcagcgggatg

SEQ ID NO: 426458 - DNA, 23 bp, Artificial Sequence
  Description of Artificial Sequence: Synthetic oligonucleotide
cacgctgacctggcagcgggatg

SEQ ID NO: 426459 - DNA, 23 bp, Artificial Sequence
  Description of Artificial Sequence: Synthetic oligonucleotide
acgctgacctggcagcgggatgg

SEQ ID NO: 426460 - DNA, 22 bp, Artificial Sequence
  Description of Artificial Sequence: Synthetic oligonucleotide
cgctgacctggcagcgggatgg

SEQ ID NO: 426461 - DNA, 22 bp, Artificial Sequence
  Description of Artificial Sequence: Synthetic oligonucleotide
gctgacctggcagcgggatggg

SEQ ID NO: 426462 - DNA, 24 bp, Artificial Sequence
  Description of Artificial Sequence: Synthetic oligonucleotide
acctggcagcgggatggggaggaa

SEQ ID NO: 426463 - DNA, 23 bp, Artificial Sequence
  Description of Artificial Sequence: Synthetic oligonucleotide
cctggcagcgggatggggaggaa

SEQ ID NO: 426464 - DNA, 24 bp, Artificial Sequence
  Description of Artificial Sequence: Synthetic oligonucleotide
ctggcagcgggatggggaggaaca

SEQ ID NO: 426465 - DNA, 25 bp, Artificial Sequence
  Description of Artificial Sequence: Synthetic oligonucleotide
tggcagcgggatggggaggaacaga

SEQ ID NO: 426466 - DNA, 24 bp, Artificial Sequence
  Description of Artificial Sequence: Synthetic oligonucleotide
ggcagcgggatggggaggaacaga

SEQ ID NO: 426467 - DNA, 24 bp, Artificial Sequence
  Description of Artificial Sequence: Synthetic oligonucleotide
gcagcgggatggggaggaacagac

SEQ ID NO: 426468 - DNA, 24 bp, Artificial Sequence
  Description of Artificial Sequence: Synthetic oligonucleotide
cagcgggatggggaggaacagacc

SEQ ID NO: 426469 - DNA, 25 bp, Artificial Sequence
  Description of Artificial Sequence: Synthetic oligonucleotide
agcgggatggggaggaacagaccca

SEQ ID NO: 426470 - DNA, 24 bp, Artificial Sequence
  Description of Artificial Sequence: Synthetic oligonucleotide
gcgggatggggaggaacagaccca

SEQ ID NO: 426471 - DNA, 24 bp, Artificial Sequence
  Description of Artificial Sequence: Synthetic oligonucleotide
cgggatggggaggaacagacccag

SEQ ID NO: 426472 - DNA, 25 bp, Artificial Sequence
  Description of Artificial Sequence: Synthetic oligonucleotide
gggatggggaggaacagacccagga

SEQ ID NO: 426473 - DNA, 26 bp, Artificial Sequence
  Description of Artificial Sequence: Synthetic oligonucleotide
ggatggggaggaacagacccaggaca

SEQ ID NO: 426474 - DNA, 27 bp, Artificial Sequence
  Description of Artificial Sequence: Synthetic oligonucleotide
gatggggaggaacagacccaggacaca

SEQ ID NO: 426475 - DNA, 27 bp, Artificial Sequence
  Description of Artificial Sequence: Synthetic oligonucleotide
atggggaggaacagacccaggacacag

SEQ ID NO: 426476 - DNA, 27 bp, Artificial Sequence
  Description of Artificial Sequence: Synthetic oligonucleotide
tggggaggaacagacccaggacacaga

SEQ ID NO: 426477 - DNA, 26 bp, Artificial Sequence
  Description of Artificial Sequence: Synthetic oligonucleotide
ggggaggaacagacccaggacacaga

SEQ ID NO: 426478 - DNA, 26 bp, Artificial Sequence
  Description of Artificial Sequence: Synthetic oligonucleotide
gggaggaacagacccaggacacagag

SEQ ID NO: 426479 - DNA, 27 bp, Artificial Sequence
  Description of Artificial Sequence: Synthetic oligonucleotide
ggaggaacagacccaggacacagagct

SEQ ID NO: 426480 - DNA, 28 bp, Artificial Sequence
  Description of Artificial Sequence: Synthetic oligonucleotide
gaggaacagacccaggacacagagcttg

SEQ ID NO: 426481 - DNA, 29 bp, Artificial Sequence
  Description of Artificial Sequence: Synthetic oligonucleotide
aggaacagacccaggacacagagcttgtg

SEQ ID NO: 426482 - DNA, 28 bp, Artificial Sequence
  Description of Artificial Sequence: Synthetic oligonucleotide
ggaacagacccaggacacagagcttgtg

SEQ ID NO: 426483 - DNA, 28 bp, Artificial Sequence
  Description of Artificial Sequence: Synthetic oligonucleotide
gaacagacccaggacacagagcttgtgg

SEQ ID NO: 426484 - DNA, 29 bp, Artificial Sequence
  Description of Artificial Sequence: Synthetic oligonucleotide
aacagacccaggacacagagcttgtggag

SEQ ID NO: 426485 - DNA, 28 bp, Artificial Sequence
  Description of Artificial Sequence: Synthetic oligonucleotide
acagacccaggacacagagcttgtggag

SEQ ID NO: 426486 - DNA, 27 bp, Artificial Sequence
  Description of Artificial Sequence: Synthetic oligonucleotide
cagacccaggacacagagcttgtggag

SEQ ID NO: 426487 - DNA, 28 bp, Artificial Sequence
  Description of Artificial Sequence: Synthetic oligonucleotide
agacccaggacacagagcttgtggagac

SEQ ID NO: 426488 - DNA, 27 bp, Artificial Sequence
  Description of Artificial Sequence: Synthetic oligonucleotide
gacccaggacacagagcttgtggagac

SEQ ID NO: 426489 - DNA, 27 bp, Artificial Sequence
  Description of Artificial Sequence: Synthetic oligonucleotide
acccaggacacagagcttgtggagacc

SEQ ID NO: 426490 - DNA, 27 bp, Artificial Sequence
  Description of Artificial Sequence: Synthetic oligonucleotide
cccaggacacagagcttgtggagacca

SEQ ID NO: 426491 - DNA, 27 bp, Artificial Sequence
  Description of Artificial Sequence: Synthetic oligonucleotide
ccaggacacagagcttgtggagaccag

SEQ ID NO: 426492 - DNA, 27 bp, Artificial Sequence
  Description of Artificial Sequence: Synthetic oligonucleotide
caggacacagagcttgtggagaccagg

SEQ ID NO: 426493 - DNA, 27 bp, Artificial Sequence
  Description of Artificial Sequence: Synthetic oligonucleotide
aggacacagagcttgtggagaccaggc

SEQ ID NO: 426494 - DNA, 26 bp, Artificial Sequence
  Description of Artificial Sequence: Synthetic oligonucleotide
ggacacagagcttgtggagaccaggc

SEQ ID NO: 426495 - DNA, 27 bp, Artificial Sequence
  Description of Artificial Sequence: Synthetic oligonucleotide
gacacagagcttgtggagaccaggcct

SEQ ID NO: 426496 - DNA, 27 bp, Artificial Sequence
  Description of Artificial Sequence: Synthetic oligonucleotide
acacagagcttgtggagaccaggcctg

SEQ ID NO: 426497 - DNA, 26 bp, Artificial Sequence
  Description of Artificial Sequence: Synthetic oligonucleotide
cacagagcttgtggagaccaggcctg

SEQ ID NO: 426498 - DNA, 27 bp, Artificial Sequence
  Description of Artificial Sequence: Synthetic oligonucleotide
acagagcttgtggagaccaggcctgca

SEQ ID NO: 426499 - DNA, 26 bp, Artificial Sequence
  Description of Artificial Sequence: Synthetic oligonucleotide
cagagcttgtggagaccaggcctgca

SEQ ID NO: 426500 - DNA, 26 bp, Artificial Sequence
  Description of Artificial Sequence: Synthetic oligonucleotide
agagcttgtggagaccaggcctgcag

SEQ ID NO: 426501 - DNA, 25 bp, Artificial Sequence
  Description of Artificial Sequence: Synthetic oligonucleotide
ccgctgtggtggtgccttctggaga

SEQ ID NO: 426502 - DNA, 25 bp, Artificial Sequence
  Description of Artificial Sequence: Synthetic oligonucleotide
cgctgtggtggtgccttctggagag

SEQ ID NO: 426503 - DNA, 27 bp, Artificial Sequence
  Description of Artificial Sequence: Synthetic oligonucleotide
gctgtggtggtgccttctggagaggaa

SEQ ID NO: 426504 - DNA, 27 bp, Artificial Sequence
  Description of Artificial Sequence: Synthetic oligonucleotide
ctgtggtggtgccttctggagaggaac

SEQ ID NO: 426505 - DNA, 28 bp, Artificial Sequence
  Description of Artificial Sequence: Synthetic oligonucleotide
tgtggtggtgccttctggagaggaacag

SEQ ID NO: 426506 - DNA, 27 bp, Artificial Sequence
  Description of Artificial Sequence: Synthetic oligonucleotide
gtggtggtgccttctggagaggaacag

SEQ ID NO: 426507 - DNA, 28 bp, Artificial Sequence
  Description of Artificial Sequence: Synthetic oligonucleotide
tggtggtgccttctggagaggaacagag

SEQ ID NO: 426508 - DNA, 27 bp, Artificial Sequence
  Description of Artificial Sequence: Synthetic oligonucleotide
ggtggtgccttctggagaggaacagag

SEQ ID NO: 426509 - DNA, 30 bp, Artificial Sequence; identical to SEQ ID NO: 77040
  Description of Artificial Sequence: Synthetic oligonucleotide

SEQ ID NO: 426510 - DNA, 31 bp, Artificial Sequence; identical to SEQ ID NO: 77041
  Description of Artificial Sequence: Synthetic oligonucleotide

SEQ ID NO: 426511 - DNA, 30 bp, Artificial Sequence; identical to SEQ ID NO: 77042
  Description of Artificial Sequence: Synthetic oligonucleotide

SEQ ID NO: 426512 - DNA, 32 bp, Artificial Sequence; identical to SEQ ID NO: 77043
  Description of Artificial Sequence: Synthetic oligonucleotide

SEQ ID NO: 426513 - DNA, 32 bp, Artificial Sequence; identical to SEQ ID NO: 77044
  Description of Artificial Sequence: Synthetic oligonucleotide

SEQ ID NO: 426514 - DNA, 31 bp, Artificial Sequence; identical to SEQ ID NO: 77045
  Description of Artificial Sequence: Synthetic oligonucleotide

SEQ ID NO: 426515 - DNA, 31 bp, Artificial Sequence; identical to SEQ ID NO: 77046
  Description of Artificial Sequence: Synthetic oligonucleotide

SEQ ID NO: 426516 - DNA, 33 bp, Artificial Sequence; identical to SEQ ID NO: 77047
  Description of Artificial Sequence: Synthetic oligonucleotide

SEQ ID NO: 426517 - DNA, 34 bp, Artificial Sequence; identical to SEQ ID NO: 77048
  Description of Artificial Sequence: Synthetic oligonucleotide

SEQ ID NO: 426518 - DNA, 33 bp, Artificial Sequence; identical to SEQ ID NO: 77049
  Description of Artificial Sequence: Synthetic oligonucleotide

SEQ ID NO: 426519 - DNA, 32 bp, Artificial Sequence; identical to SEQ ID NO: 77050
  Description of Artificial Sequence: Synthetic oligonucleotide

SEQ ID NO: 426520 - DNA, 32 bp, Artificial Sequence; identical to SEQ ID NO: 77051
  Description of Artificial Sequence: Synthetic oligonucleotide

SEQ ID NO: 426521 - DNA, 31 bp, Artificial Sequence; identical to SEQ ID NO: 77052
  Description of Artificial Sequence: Synthetic oligonucleotide

SEQ ID NO: 426522 - DNA, 32 bp, Artificial Sequence; identical to SEQ ID NO: 77053
  Description of Artificial Sequence: Synthetic oligonucleotide

SEQ ID NO: 426523 - DNA, 32 bp, Artificial Sequence; identical to SEQ ID NO: 77054
  Description of Artificial Sequence: Synthetic oligonucleotide

SEQ ID NO: 426524 - DNA, 31 bp, Artificial Sequence; identical to SEQ ID NO: 77055
  Description of Artificial Sequence: Synthetic oligonucleotide

SEQ ID NO: 426525 - DNA, 32 bp, Artificial Sequence; identical to SEQ ID NO: 77056
  Description of Artificial Sequence: Synthetic oligonucleotide

SEQ ID NO: 426526 - DNA, 31 bp, Artificial Sequence; identical to SEQ ID NO: 77057
  Description of Artificial Sequence: Synthetic oligonucleotide

SEQ ID NO: 426527 - DNA, 31 bp, Artificial Sequence; identical to SEQ ID NO: 77058
  Description of Artificial Sequence: Synthetic oligonucleotide

SEQ ID NO: 426528 - DNA, 32 bp, Artificial Sequence; identical to SEQ ID NO: 77059
  Description of Artificial Sequence: Synthetic oligonucleotide

SEQ ID NO: 426529 - DNA, 31 bp, Artificial Sequence; identical to SEQ ID NO: 77060
  Description of Artificial Sequence: Synthetic oligonucleotide

SEQ ID NO: 426530 - DNA, 23 bp, Artificial Sequence
  Description of Artificial Sequence: Synthetic oligonucleotide
atgtgcagcacgaggggctgccc

SEQ ID NO: 426531 - DNA, 22 bp, Artificial Sequence
  Description of Artificial Sequence: Synthetic oligonucleotide
tgtgcagcacgaggggctgccc

SEQ ID NO: 426532 - DNA, 21 bp, Artificial Sequence
  Description of Artificial Sequence: Synthetic oligonucleotide
gtgcagcacgaggggctgccc

SEQ ID NO: 426533 - DNA, 22 bp, Artificial Sequence
  Description of Artificial Sequence: Synthetic oligonucleotide
tgcagcacgaggggctgcccca

SEQ ID NO: 426534 - DNA, 21 bp, Artificial Sequence
  Description of Artificial Sequence: Synthetic oligonucleotide
gcagcacgaggggctgcccca

SEQ ID NO: 426535 - DNA, 21 bp, Artificial Sequence
  Description of Artificial Sequence: Synthetic oligonucleotide
cagcacgaggggctgccccag

SEQ ID NO: 426536 - DNA, 21 bp, Artificial Sequence
  Description of Artificial Sequence: Synthetic oligonucleotide
agcacgaggggctgccccagc

SEQ ID NO: 426537 - DNA, 20 bp, Artificial Sequence
  Description of Artificial Sequence: Synthetic oligonucleotide
gcacgaggggctgccccagc

SEQ ID NO: 426538 - DNA, 20 bp, Artificial Sequence
  Description of Artificial Sequence: Synthetic oligonucleotide
cacgaggggctgccccagcc

SEQ ID NO: 426539 - DNA, 20 bp, Artificial Sequence
  Description of Artificial Sequence: Synthetic oligonucleotide
acgaggggctgccccagccc

SEQ ID NO: 426540 - DNA, 20 bp, Artificial Sequence
  Description of Artificial Sequence: Synthetic oligonucleotide
cgaggggctgccccagccct

SEQ ID NO: 426541 - DNA, 20 bp, Artificial Sequence
  Description of Artificial Sequence: Synthetic oligonucleotide
gaggggctgccccagcccct

SEQ ID NO: 426542 - DNA, 22 bp, Artificial Sequence
  Description of Artificial Sequence: Synthetic oligonucleotide
aggggctgccccagcccctcat

SEQ ID NO: 426543 - DNA, 21 bp, Artificial Sequence
  Description of Artificial Sequence: Synthetic oligonucleotide
ggggctgccccagcccctcat

SEQ ID NO: 426544 - DNA, 21 bp, Artificial Sequence
  Description of Artificial Sequence: Synthetic oligonucleotide
gggctgccccagcccctcatc

SEQ ID NO: 426545 - DNA, 22 bp, Artificial Sequence
  Description of Artificial Sequence: Synthetic oligonucleotide
ggctgccccagcccctcatcct

SEQ ID NO: 426546 - DNA, 23 bp, Artificial Sequence
  Description of Artificial Sequence: Synthetic oligonucleotide
gctgccccagcccctcatcctga

SEQ ID NO: 426547 - DNA, 25 bp, Artificial Sequence
  Description of Artificial Sequence: Synthetic oligonucleotide
ctgccccagcccctcatcctgagat

SEQ ID NO: 426548 - DNA, 25 bp, Artificial Sequence
  Description of Artificial Sequence: Synthetic oligonucleotide
tgccccagcccctcatcctgagatg

SEQ ID NO: 426549 - DNA, 24 bp, Artificial Sequence
  Description of Artificial Sequence: Synthetic oligonucleotide
gccccagcccctcatcctgagatg

SEQ ID NO: 426550 - DNA, 24 bp, Artificial Sequence
  Description of Artificial Sequence: Synthetic oligonucleotide
ccccagcccctcatcctgagatgg

SEQ ID NO: 426551 - DNA, 25 bp, Artificial Sequence
  Description of Artificial Sequence: Synthetic oligonucleotide
cccagcccctcatcctgagatggga

SEQ ID NO: 426552 - DNA, 25 bp, Artificial Sequence
  Description of Artificial Sequence: Synthetic oligonucleotide
ccagcccctcatcctgagatgggag

SEQ ID NO: 426553 - DNA, 26 bp, Artificial Sequence
  Description of Artificial Sequence: Synthetic oligonucleotide
cagcccctcatcctgagatgggagca

SEQ ID NO: 426554 - DNA, 27 bp, Artificial Sequence
  Description of Artificial Sequence: Synthetic oligonucleotide
agcccctcatcctgagatgggagcagt

SEQ ID NO: 426555 - DNA, 26 bp, Artificial Sequence
  Description of Artificial Sequence: Synthetic oligonucleotide
gcccctcatcctgagatgggagcagt

SEQ ID NO: 426556 - DNA, 27 bp, Artificial Sequence
  Description of Artificial Sequence: Synthetic oligonucleotide
cccctcatcctgagatgggagcagtct

SEQ ID NO: 426557 - DNA, 27 bp, Artificial Sequence
  Description of Artificial Sequence: Synthetic oligonucleotide
ccctcatcctgagatgggagcagtctc

SEQ ID NO: 426558 - DNA, 27 bp, Artificial Sequence
  Description of Artificial Sequence: Synthetic oligonucleotide
cctcatcctgagatgggagcagtctcc

SEQ ID NO: 426559 - DNA, 27 bp, Artificial Sequence
  Description of Artificial Sequence: Synthetic oligonucleotide
ctcatcctgagatgggagcagtctccc

SEQ ID NO: 426560 - DNA, 27 bp, Artificial Sequence
  Description of Artificial Sequence: Synthetic oligonucleotide
tcatcctgagatgggagcagtctcccc

SEQ ID NO: 426561 - DNA, 27 bp, Artificial Sequence
  Description of Artificial Sequence: Synthetic oligonucleotide
catcctgagatgggagcagtctcccca

SEQ ID NO: 426562 - DNA, 27 bp, Artificial Sequence
  Description of Artificial Sequence: Synthetic oligonucleotide
atcctgagatgggagcagtctccccag

SEQ ID NO: 426563 - DNA, 26 bp, Artificial Sequence
  Description of Artificial Sequence: Synthetic oligonucleotide
tcctgagatgggagcagtctccccag

SEQ ID NO: 426564 - DNA, 25 bp, Artificial Sequence
  Description of Artificial Sequence: Synthetic oligonucleotide
cctgagatgggagcagtctccccag

SEQ ID NO: 426565 - DNA, 25 bp, Artificial Sequence
  Description of Artificial Sequence: Synthetic oligonucleotide
ctgagatgggagcagtctccccagc

SEQ ID NO: 426566 - DNA, 25 bp, Artificial Sequence
  Description of Artificial Sequence: Synthetic oligonucleotide
tgagatgggagcagtctccccagcc

SEQ ID NO: 426567 - DNA, 24 bp, Artificial Sequence
  Description of Artificial Sequence: Synthetic oligonucleotide
gagatgggagcagtctccccagcc

SEQ ID NO: 426568 - DNA, 25 bp, Artificial Sequence
  Description of Artificial Sequence: Synthetic oligonucleotide
agatgggagcagtctccccagccca

SEQ ID NO: 426569 - DNA, 24 bp, Artificial Sequence
  Description of Artificial Sequence: Synthetic oligonucleotide
gatgggagcagtctccccagccca

SEQ ID NO: 426570 - DNA, 24 bp, Artificial Sequence
  Description of Artificial Sequence: Synthetic oligonucleotide
atgggagcagtctccccagcccac

SEQ ID NO: 426571 - DNA, 23 bp, Artificial Sequence
  Description of Artificial Sequence: Synthetic oligonucleotide
tgggagcagtctccccagcccac

SEQ ID NO: 426572 - DNA, 22 bp, Artificial Sequence
  Description of Artificial Sequence: Synthetic oligonucleotide
gggagcagtctccccagcccac

SEQ ID NO: 426573 - DNA, 24 bp, Artificial Sequence
  Description of Artificial Sequence: Synthetic oligonucleotide
ggagcagtctccccagcccaccat

SEQ ID NO: 426574 - DNA, 24 bp, Artificial Sequence
  Description of Artificial Sequence: Synthetic oligonucleotide
gagcagtctccccagcccaccatc

SEQ ID NO: 426575 - DNA, 24 bp, Artificial Sequence
  Description of Artificial Sequence: Synthetic oligonucleotide
agcagtctccccagcccaccatcc

SEQ ID NO: 426576 - DNA, 23 bp, Artificial Sequence
  Description of Artificial Sequence: Synthetic oligonucleotide
gcagtctccccagcccaccatcc

SEQ ID NO: 426577 - DNA, 23 bp, Artificial Sequence
  Description of Artificial Sequence: Synthetic oligonucleotide
cagtctccccagcccaccatccc

SEQ ID NO: 426578 - DNA, 25 bp, Artificial Sequence
  Description of Artificial Sequence: Synthetic oligonucleotide
agtctccccagcccaccatccccat

SEQ ID NO: 426579 - DNA, 24 bp, Artificial Sequence
  Description of Artificial Sequence: Synthetic oligonucleotide
gtctccccagcccaccatccccat

SEQ ID NO: 426580 - DNA, 24 bp, Artificial Sequence
  Description of Artificial Sequence: Synthetic oligonucleotide
tctccccagcccaccatccccatc

SEQ ID NO: 426581 - DNA, 23 bp, Artificial Sequence
  Description of Artificial Sequence: Synthetic oligonucleotide
ctccccagcccaccatccccatc

SEQ ID NO: 426582 - DNA, 24 bp, Artificial Sequence
  Description of Artificial Sequence: Synthetic oligonucleotide
tccccagcccaccatccccatcgt

SEQ ID NO: 426583 - DNA, 23 bp, Artificial Sequence
  Description of Artificial Sequence: Synthetic oligonucleotide
ccccagcccaccatccccatcgt

SEQ ID NO: 426584 - DNA, 26 bp, Artificial Sequence
  Description of Artificial Sequence: Synthetic oligonucleotide
ccatcgtgggcatcgttgctggcctt

SEQ ID NO: 426585 - DNA, 27 bp, Artificial Sequence
  Description of Artificial Sequence: Synthetic oligonucleotide
catcgtgggcatcgttgctggccttgt

SEQ ID NO: 426586 - DNA, 28 bp, Artificial Sequence
  Description of Artificial Sequence: Synthetic oligonucleotide
atcgtgggcatcgttgctggccttgttg

SEQ ID NO: 426587 - DNA, 27 bp, Artificial Sequence
  Description of Artificial Sequence: Synthetic oligonucleotide
tcgtgggcatcgttgctggccttgttg

SEQ ID NO: 426588 - DNA, 27 bp, Artificial Sequence
  Description of Artificial Sequence: Synthetic oligonucleotide
cgtgggcatcgttgctggccttgttgt

SEQ ID NO: 426589 - DNA, 27 bp, Artificial Sequence
  Description of Artificial Sequence: Synthetic oligonucleotide
gtgggcatcgttgctggccttgttgtc

SEQ ID NO: 426590 - DNA, 27 bp, Artificial Sequence
  Description of Artificial Sequence: Synthetic oligonucleotide
tgggcatcgttgctggccttgttgtcc

SEQ ID NO: 426591 - DNA, 27 bp, Artificial Sequence
  Description of Artificial Sequence: Synthetic oligonucleotide
gggcatcgttgctggccttgttgtcct

SEQ ID NO: 426592 - DNA, 28 bp, Artificial Sequence
  Description of Artificial Sequence: Synthetic oligonucleotide
ggcatcgttgctggccttgttgtccttg

SEQ ID NO: 426593 - DNA, 28 bp, Artificial Sequence
  Description of Artificial Sequence: Synthetic oligonucleotide
gcatcgttgctggccttgttgtccttgg

SEQ ID NO: 426594 - DNA, 29 bp, Artificial Sequence
  Description of Artificial Sequence: Synthetic oligonucleotide
catcgttgctggccttgttgtccttggag

SEQ ID NO: 426595 - DNA, 29 bp, Artificial Sequence
  Description of Artificial Sequence: Synthetic oligonucleotide
atcgttgctggccttgttgtccttggagc

SEQ ID NO: 426596 - DNA, 28 bp, Artificial Sequence
  Description of Artificial Sequence: Synthetic oligonucleotide
tcgttgctggccttgttgtccttggagc

SEQ ID NO: 426597 - DNA, 27 bp, Artificial Sequence
  Description of Artificial Sequence: Synthetic oligonucleotide
cgttgctggccttgttgtccttggagc

SEQ ID NO: 426598 - DNA, 28 bp, Artificial Sequence
  Description of Artificial Sequence: Synthetic oligonucleotide
gttgctggccttgttgtccttggagctg

SEQ ID NO: 426599 - DNA, 29 bp, Artificial Sequence
  Description of Artificial Sequence: Synthetic oligonucleotide
ttgctggccttgttgtccttggagctgtg

SEQ ID NO: 426600 - DNA, 28 bp, Artificial Sequence
  Description of Artificial Sequence: Synthetic oligonucleotide
tgctggccttgttgtccttggagctgtg

SEQ ID NO: 426601 - DNA, 27 bp, Artificial Sequence
  Description of Artificial Sequence: Synthetic oligonucleotide
gctggccttgttgtccttggagctgtg

SEQ ID NO: 426602 - DNA, 27 bp, Artificial Sequence
  Description of Artificial Sequence: Synthetic oligonucleotide
ctggccttgttgtccttggagctgtgg

SEQ ID NO: 426603 - DNA, 28 bp, Artificial Sequence
  Description of Artificial Sequence: Synthetic oligonucleotide
tggccttgttgtccttggagctgtggtc

SEQ ID NO: 426604 - DNA, 27 bp, Artificial Sequence
  Description of Artificial Sequence: Synthetic oligonucleotide
ggccttgttgtccttggagctgtggtc

SEQ ID NO: 426605 - DNA, 28 bp, Artificial Sequence
  Description of Artificial Sequence: Synthetic oligonucleotide
gccttgttgtccttggagctgtggtcac

SEQ ID NO: 426606 - DNA, 29 bp, Artificial Sequence
  Description of Artificial Sequence: Synthetic oligonucleotide
ccttgttgtccttggagctgtggtcactg

SEQ ID NO: 426607 - DNA, 29 bp, Artificial Sequence
  Description of Artificial Sequence: Synthetic oligonucleotide
cttgttgtccttggagctgtggtcactgg

SEQ ID NO: 426608 - DNA, 30 bp, Artificial Sequence; identical to SEQ ID NO: 77139
  Description of Artificial Sequence: Synthetic oligonucleotide

SEQ ID NO: 426609 - DNA, 29 bp, Artificial Sequence
  Description of Artificial Sequence: Synthetic oligonucleotide
tgttgtccttggagctgtggtcactggag

SEQ ID NO: 426610 - DNA, 28 bp, Artificial Sequence
  Description of Artificial Sequence: Synthetic oligonucleotide
gttgtccttggagctgtggtcactggag

SEQ ID NO: 426611 - DNA, 28 bp, Artificial Sequence
  Description of Artificial Sequence: Synthetic oligonucleotide
ttgtccttggagctgtggtcactggagc

SEQ ID NO: 426612 - DNA, 27 bp, Artificial Sequence
  Description of Artificial Sequence: Synthetic oligonucleotide
tgtccttggagctgtggtcactggagc

SEQ ID NO: 426613 - DNA, 27 bp, Artificial Sequence
  Description of Artificial Sequence: Synthetic oligonucleotide
gtccttggagctgtggtcactggagct

SEQ ID NO: 426614 - DNA, 27 bp, Artificial Sequence
  Description of Artificial Sequence: Synthetic oligonucleotide
tccttggagctgtggtcactggagctg

SEQ ID NO: 426615 - DNA, 27 bp, Artificial Sequence
  Description of Artificial Sequence: Synthetic oligonucleotide
ccttggagctgtggtcactggagctgt

SEQ ID NO: 426616 - DNA, 27 bp, Artificial Sequence
  Description of Artificial Sequence: Synthetic oligonucleotide
cttggagctgtggtcactggagctgtg

SEQ ID NO: 426617 - DNA, 27 bp, Artificial Sequence
  Description of Artificial Sequence: Synthetic oligonucleotide
ttggagctgtggtcactggagctgtgg

SEQ ID NO: 426618 - DNA, 27 bp, Artificial Sequence
  Description of Artificial Sequence: Synthetic oligonucleotide
tggagctgtggtcactggagctgtggt

SEQ ID NO: 426619 - DNA, 26 bp, Artificial Sequence
  Description of Artificial Sequence: Synthetic oligonucleotide
ggagctgtggtcactggagctgtggt

SEQ ID NO: 426620 - DNA, 26 bp, Artificial Sequence
  Description of Artificial Sequence: Synthetic oligonucleotide
gagctgtggtcactggagctgtggtc

SEQ ID NO: 426621 - DNA, 26 bp, Artificial Sequence
  Description of Artificial Sequence: Synthetic oligonucleotide
agctgtggtcactggagctgtggtcg

SEQ ID NO: 426622 - DNA, 25 bp, Artificial Sequence
  Description of Artificial Sequence: Synthetic oligonucleotide
gctgtggtcactggagctgtggtcg

SEQ ID NO: 426623 - DNA, 26 bp, Artificial Sequence
  Description of Artificial Sequence: Synthetic oligonucleotide
ctgtggtcactggagctgtggtcgct

SEQ ID NO: 426624 - DNA, 26 bp, Artificial Sequence
  Description of Artificial Sequence: Synthetic oligonucleotide
tgtggtcactggagctgtggtcgctg

SEQ ID NO: 426625 - DNA, 25 bp, Artificial Sequence
  Description of Artificial Sequence: Synthetic oligonucleotide
gtggtcactggagctgtggtcgctg

SEQ ID NO: 426626 - DNA, 26 bp, Artificial Sequence
  Description of Artificial Sequence: Synthetic oligonucleotide
tggtcactggagctgtggtcgctgct

SEQ ID NO: 426627 - DNA, 25 bp, Artificial Sequence
  Description of Artificial Sequence: Synthetic oligonucleotide
ggtcactggagctgtggtcgctgct

SEQ ID NO: 426628 - DNA, 26 bp, Artificial Sequence
  Description of Artificial Sequence: Synthetic oligonucleotide
gtcactggagctgtggtcgctgctgt

SEQ ID NO: 426629 - DNA, 28 bp, Artificial Sequence
  Description of Artificial Sequence: Synthetic oligonucleotide
tgtggtcgctgctgtgatgtggaggaag

SEQ ID NO: 426630 - DNA, 27 bp, Artificial Sequence
  Description of Artificial Sequence: Synthetic oligonucleotide
gtggtcgctgctgtgatgtggaggaag

SEQ ID NO: 426631 - DNA, 29 bp, Artificial Sequence
  Description of Artificial Sequence: Synthetic oligonucleotide
tggtcgctgctgtgatgtggaggaagaag

SEQ ID NO: 426632 - DNA, 28 bp, Artificial Sequence
  Description of Artificial Sequence: Synthetic oligonucleotide
ggtcgctgctgtgatgtggaggaagaag

SEQ ID NO: 426633 - DNA, 29 bp, Artificial Sequence
  Description of Artificial Sequence: Synthetic oligonucleotide
gtcgctgctgtgatgtggaggaagaagag

SEQ ID NO: 426634 - DNA, 29 bp, Artificial Sequence
  Description of Artificial Sequence: Synthetic oligonucleotide
tcgctgctgtgatgtggaggaagaagagc

SEQ ID NO: 426635 - DNA, 28 bp, Artificial Sequence
  Description of Artificial Sequence: Synthetic oligonucleotide
cgctgctgtgatgtggaggaagaagagc

SEQ ID NO: 426636 - DNA, 29 bp, Artificial Sequence
  Description of Artificial Sequence: Synthetic oligonucleotide
gctgctgtgatgtggaggaagaagagctc

SEQ ID NO: 426637 - DNA, 30 bp, Artificial Sequence; identical to SEQ ID NO: 77168
  Description of Artificial Sequence: Synthetic oligonucleotide

SEQ ID NO: 426638 - DNA, 33 bp, Artificial Sequence; identical to SEQ ID NO: 77169
  Description of Artificial Sequence: Synthetic oligonucleotide

SEQ ID NO: 426639 - DNA, 32 bp, Artificial Sequence; identical to SEQ ID NO: 77170
  Description of Artificial Sequence: Synthetic oligonucleotide

SEQ ID NO: 426640 - DNA, 35 bp, Artificial Sequence; identical to SEQ ID NO: 77171
  Description of Artificial Sequence: Synthetic oligonucleotide

SEQ ID NO: 426641 - DNA, 36 bp, Artificial Sequence; identical to SEQ ID NO: 77172
  Description of Artificial Sequence: Synthetic oligonucleotide

SEQ ID NO: 426642 - DNA, 35 bp, Artificial Sequence; identical to SEQ ID NO: 77173
  Description of Artificial Sequence: Synthetic oligonucleotide

SEQ ID NO: 426643 - DNA, 36 bp, Artificial Sequence; identical to SEQ ID NO: 77174
  Description of Artificial Sequence: Synthetic oligonucleotide

SEQ ID NO: 426644 - DNA, 35 bp, Artificial Sequence; identical to SEQ ID NO: 77175
  Description of Artificial Sequence: Synthetic oligonucleotide

SEQ ID NO: 426645 - DNA, 35 bp, Artificial Sequence; identical to SEQ ID NO: 77176
  Description of Artificial Sequence: Synthetic oligonucleotide

SEQ ID NO: 426646 - DNA, 34 bp, Artificial Sequence; identical to SEQ ID NO: 77177
  Description of Artificial Sequence: Synthetic oligonucleotide

SEQ ID NO: 426647 - DNA, 33 bp, Artificial Sequence; identical to SEQ ID NO: 77178
  Description of Artificial Sequence: Synthetic oligonucleotide

SEQ ID NO: 426648 - DNA, 33 bp, Artificial Sequence; identical to SEQ ID NO: 77179
  Description of Artificial Sequence: Synthetic oligonucleotide

SEQ ID NO: 426649 - DNA, 32 bp, Artificial Sequence; identical to SEQ ID NO: 77180
  Description of Artificial Sequence: Synthetic oligonucleotide

SEQ ID NO: 426650 - DNA, 33 bp, Artificial Sequence; identical to SEQ ID NO: 77181
  Description of Artificial Sequence: Synthetic oligonucleotide

SEQ ID NO: 426651 - DNA, 33 bp, Artificial Sequence; identical to SEQ ID NO: 77182
  Description of Artificial Sequence: Synthetic oligonucleotide

SEQ ID NO: 426652 - DNA, 32 bp, Artificial Sequence; identical to SEQ ID NO: 77183
  Description of Artificial Sequence: Synthetic oligonucleotide

SEQ ID NO: 426653 - DNA, 34 bp, Artificial Sequence; identical to SEQ ID NO: 77184
  Description of Artificial Sequence: Synthetic oligonucleotide

SEQ ID NO: 426654 - DNA, 35 bp, Artificial Sequence; identical to SEQ ID NO: 77185
  Description of Artificial Sequence: Synthetic oligonucleotide

SEQ ID NO: 426655 - DNA, 34 bp, Artificial Sequence; identical to SEQ ID NO: 77186
  Description of Artificial Sequence: Synthetic oligonucleotide

SEQ ID NO: 426656 - DNA, 33 bp, Artificial Sequence; identical to SEQ ID NO: 77187
  Description of Artificial Sequence: Synthetic oligonucleotide

SEQ ID NO: 426657 - DNA, 34 bp, Artificial Sequence; identical to SEQ ID NO: 77188
  Description of Artificial Sequence: Synthetic oligonucleotide

SEQ ID NO: 426658 - DNA, 33 bp, Artificial Sequence; identical to SEQ ID NO: 77189
  Description of Artificial Sequence: Synthetic oligonucleotide

SEQ ID NO: 426659 - DNA, 32 bp, Artificial Sequence; identical to SEQ ID NO: 77190
  Description of Artificial Sequence: Synthetic oligonucleotide

SEQ ID NO: 426660 - DNA, 33 bp, Artificial Sequence; identical to SEQ ID NO: 77191
  Description of Artificial Sequence: Synthetic oligonucleotide

SEQ ID NO: 426661 - DNA, 32 bp, Artificial Sequence; identical to SEQ ID NO: 77192
  Description of Artificial Sequence: Synthetic oligonucleotide

SEQ ID NO: 426662 - DNA, 32 bp, Artificial Sequence; identical to SEQ ID NO: 77193
  Description of Artificial Sequence: Synthetic oligonucleotide

SEQ ID NO: 426663 - DNA, 32 bp, Artificial Sequence; identical to SEQ ID NO: 77194
  Description of Artificial Sequence: Synthetic oligonucleotide

SEQ ID NO: 426664 - DNA, 31 bp, Artificial Sequence; identical to SEQ ID NO: 77195
  Description of Artificial Sequence: Synthetic oligonucleotide

SEQ ID NO: 426665 - DNA, 32 bp, Artificial Sequence; identical to SEQ ID NO: 77196
  Description of Artificial Sequence: Synthetic oligonucleotide

SEQ ID NO: 426666 - DNA, 31 bp, Artificial Sequence; identical to SEQ ID NO: 77197
  Description of Artificial Sequence: Synthetic oligonucleotide

SEQ ID NO: 426667 - DNA, 31 bp, Artificial Sequence; identical to SEQ ID NO: 77198
  Description of Artificial Sequence: Synthetic oligonucleotide

SEQ ID NO: 426668 - DNA, 30 bp, Artificial Sequence; identical to SEQ ID NO: 77199
  Description of Artificial Sequence: Synthetic oligonucleotide

SEQ ID NO: 426669 - DNA, 29 bp, Artificial Sequence
  Description of Artificial Sequence: Synthetic oligonucleotide
agaaacagagggagctactctcaggctgc

SEQ ID NO: 426670 - DNA, 28 bp, Artificial Sequence
  Description of Artificial Sequence: Synthetic oligonucleotide
gaaacagagggagctactctcaggctgc

SEQ ID NO: 426671 - DNA, 29 bp, Artificial Sequence
  Description of Artificial Sequence: Synthetic oligonucleotide
aaacagagggagctactctcaggctgcag

SEQ ID NO: 426672 - DNA, 28 bp, Artificial Sequence
  Description of Artificial Sequence: Synthetic oligonucleotide
aacagagggagctactctcaggctgcag

SEQ ID NO: 426673 - DNA, 27 bp, Artificial Sequence
  Description of Artificial Sequence: Synthetic oligonucleotide
acagagggagctactctcaggctgcag

SEQ ID NO: 426674 - DNA, 27 bp, Artificial Sequence
  Description of Artificial Sequence: Synthetic oligonucleotide
cagagggagctactctcaggctgcagt

SEQ ID NO: 426675 - DNA, 27 bp, Artificial Sequence
  Description of Artificial Sequence: Synthetic oligonucleotide
agagggagctactctcaggctgcagtc

SEQ ID NO: 426676 - DNA, 27 bp, Artificial Sequence
  Description of Artificial Sequence: Synthetic oligonucleotide
gagggagctactctcaggctgcagtca

SEQ ID NO: 426677 - DNA, 27 bp, Artificial Sequence
  Description of Artificial Sequence: Synthetic oligonucleotide
agggagctactctcaggctgcagtcac

SEQ ID NO: 426678 - DNA, 27 bp, Artificial Sequence
  Description of Artificial Sequence: Synthetic oligonucleotide
gggagctactctcaggctgcagtcact

SEQ ID NO: 426679 - DNA, 27 bp, Artificial Sequence
  Description of Artificial Sequence: Synthetic oligonucleotide
ggagctactctcaggctgcagtcactg

SEQ ID NO: 426680 - DNA, 28 bp, Artificial Sequence
  Description of Artificial Sequence: Synthetic oligonucleotide
gagctactctcaggctgcagtcactgac

SEQ ID NO: 426681 - DNA, 29 bp, Artificial Sequence
  Description of Artificial Sequence: Synthetic oligonucleotide
agctactctcaggctgcagtcactgacag

SEQ ID NO: 426682 - DNA, 28 bp, Artificial Sequence
  Description of Artificial Sequence: Synthetic oligonucleotide
gctactctcaggctgcagtcactgacag

SEQ ID NO: 426683 - DNA, 29 bp, Artificial Sequence
  Description of Artificial Sequence: Synthetic oligonucleotide
ctactctcaggctgcagtcactgacagtg

SEQ ID NO: 426684 - DNA, 29 bp, Artificial Sequence
  Description of Artificial Sequence: Synthetic oligonucleotide
tactctcaggctgcagtcactgacagtgc

SEQ ID NO: 426685 - DNA, 28 bp, Artificial Sequence
  Description of Artificial Sequence: Synthetic oligonucleotide
actctcaggctgcagtcactgacagtgc

SEQ ID NO: 426686 - DNA, 27 bp, Artificial Sequence
  Description of Artificial Sequence: Synthetic oligonucleotide
ctctcaggctgcagtcactgacagtgc

SEQ ID NO: 426687 - DNA, 27 bp, Artificial Sequence
  Description of Artificial Sequence: Synthetic oligonucleotide
tctcaggctgcagtcactgacagtgcc

SEQ ID NO: 426688 - DNA, 26 bp, Artificial Sequence
  Description of Artificial Sequence: Synthetic oligonucleotide
ctcaggctgcagtcactgacagtgcc

SEQ ID NO: 426689 - DNA, 27 bp, Artificial Sequence
  Description of Artificial Sequence: Synthetic oligonucleotide
tcaggctgcagtcactgacagtgccca

SEQ ID NO: 426690 - DNA, 26 bp, Artificial Sequence
  Description of Artificial Sequence: Synthetic oligonucleotide
caggctgcagtcactgacagtgccca

SEQ ID NO: 426691 - DNA, 26 bp, Artificial Sequence
  Description of Artificial Sequence: Synthetic oligonucleotide
aggctgcagtcactgacagtgcccag

SEQ ID NO: 426692 - DNA, 25 bp, Artificial Sequence
  Description of Artificial Sequence: Synthetic oligonucleotide
ggctgcagtcactgacagtgcccag

SEQ ID NO: 426693 - DNA, 25 bp, Artificial Sequence
  Description of Artificial Sequence: Synthetic oligonucleotide
gctgcagtcactgacagtgcccagg

SEQ ID NO: 426694 - DNA, 25 bp, Artificial Sequence
  Description of Artificial Sequence: Synthetic oligonucleotide
ctgcagtcactgacagtgcccaggg

SEQ ID NO: 426695 - DNA, 26 bp, Artificial Sequence
  Description of Artificial Sequence: Synthetic oligonucleotide
tgcagtcactgacagtgcccagggct

SEQ ID NO: 426696 - DNA, 25 bp, Artificial Sequence
  Description of Artificial Sequence: Synthetic oligonucleotide
gcagtcactgacagtgcccagggct

SEQ ID NO: 426697 - DNA, 26 bp, Artificial Sequence
  Description of Artificial Sequence: Synthetic oligonucleotide
cagtcactgacagtgcccagggctct

SEQ ID NO: 426698 - DNA, 26 bp, Artificial Sequence
  Description of Artificial Sequence: Synthetic oligonucleotide
agtcactgacagtgcccagggctctg

SEQ ID NO: 426699 - DNA, 25 bp, Artificial Sequence
  Description of Artificial Sequence: Synthetic oligonucleotide
gtcactgacagtgcccagggctctg

SEQ ID NO: 426700 - DNA, 25 bp, Artificial Sequence
  Description of Artificial Sequence: Synthetic oligonucleotide
tcactgacagtgcccagggctctgg

SEQ ID NO: 426701 - DNA, 24 bp, Artificial Sequence
  Description of Artificial Sequence: Synthetic oligonucleotide
cactgacagtgcccagggctctgg

SEQ ID NO: 426702 - DNA, 24 bp, Artificial Sequence
  Description of Artificial Sequence: Synthetic oligonucleotide
actgacagtgcccagggctctggg

SEQ ID NO: 426703 - DNA, 23 bp, Artificial Sequence
  Description of Artificial Sequence: Synthetic oligonucleotide
ctgacagtgcccagggctctggg

SEQ ID NO: 426704 - DNA, 24 bp, Artificial Sequence
  Description of Artificial Sequence: Synthetic oligonucleotide
tgacagtgcccagggctctggggt

SEQ ID NO: 426705 - DNA, 23 bp, Artificial Sequence
  Description of Artificial Sequence: Synthetic oligonucleotide
gacagtgcccagggctctggggt

SEQ ID NO: 426706 - DNA, 24 bp, Artificial Sequence
  Description of Artificial Sequence: Synthetic oligonucleotide
acagtgcccagggctctggggtgt

SEQ ID NO: 426707 - DNA, 23 bp, Artificial Sequence
  Description of Artificial Sequence: Synthetic oligonucleotide
cagtgcccagggctctggggtgt

SEQ ID NO: 426708 - DNA, 24 bp, Artificial Sequence
  Description of Artificial Sequence: Synthetic oligonucleotide
agtgcccagggctctggggtgtct

SEQ ID NO: 426709 - DNA, 23 bp, Artificial Sequence
  Description of Artificial Sequence: Synthetic oligonucleotide
gtgcccagggctctggggtgtct

SEQ ID NO: 426710 - DNA, 24 bp, Artificial Sequence
  Description of Artificial Sequence: Synthetic oligonucleotide
tgcccagggctctggggtgtctct

SEQ ID NO: 426711 - DNA, 23 bp, Artificial Sequence
  Description of Artificial Sequence: Synthetic oligonucleotide
gcccagggctctggggtgtctct

SEQ ID NO: 426712 - DNA, 24 bp, Artificial Sequence
  Description of Artificial Sequence: Synthetic oligonucleotide
cccagggctctggggtgtctctca

SEQ ID NO: 426713 - DNA, 25 bp, Artificial Sequence
  Description of Artificial Sequence: Synthetic oligonucleotide
ccagggctctggggtgtctctcaca

SEQ ID NO: 426714 - DNA, 25 bp, Artificial Sequence
  Description of Artificial Sequence: Synthetic oligonucleotide
cagggctctggggtgtctctcacag

SEQ ID NO: 426715 - DNA, 27 bp, Artificial Sequence
  Description of Artificial Sequence: Synthetic oligonucleotide
agggctctggggtgtctctcacagcta

SEQ ID NO: 426716 - DNA, 27 bp, Artificial Sequence
  Description of Artificial Sequence: Synthetic oligonucleotide
gggctctggggtgtctctcacagctaa

SEQ ID NO: 426717 - DNA, 31 bp, Artificial Sequence; identical to SEQ ID NO: 77248
  Description of Artificial Sequence: Synthetic oligonucleotide

SEQ ID NO: 426718 - DNA, 32 bp, Artificial Sequence; identical to SEQ ID NO: 77249
  Description of Artificial Sequence: Synthetic oligonucleotide

SEQ ID NO: 426719 - DNA, 33 bp, Artificial Sequence; identical to SEQ ID NO: 77250
  Description of Artificial Sequence: Synthetic oligonucleotide

SEQ ID NO: 426720 - DNA, 22 bp, Artificial Sequence
  Description of Artificial Sequence: Synthetic oligonucleotide
ccgaggcggtgtctggggttgg

SEQ ID NO: 426721 - DNA, 23 bp, Artificial Sequence
  Description of Artificial Sequence: Synthetic oligonucleotide
cgaggcggtgtctggggttggga

SEQ ID NO: 426722 - DNA, 23 bp, Artificial Sequence
  Description of Artificial Sequence: Synthetic oligonucleotide
gaggcggtgtctggggttgggag

SEQ ID NO: 426723 - DNA, 23 bp, Artificial Sequence
  Description of Artificial Sequence: Synthetic oligonucleotide
aggcggtgtctggggttgggagg

SEQ ID NO: 426724 - DNA, 22 bp, Artificial Sequence
  Description of Artificial Sequence: Synthetic oligonucleotide
ggcggtgtctggggttgggagg

SEQ ID NO: 426725 - DNA, 23 bp, Artificial Sequence
  Description of Artificial Sequence: Synthetic oligonucleotide
gcggtgtctggggttgggaggct

SEQ ID NO: 426726 - DNA, 24 bp, Artificial Sequence
  Description of Artificial Sequence: Synthetic oligonucleotide
cggtgtctggggttgggaggctca

SEQ ID NO: 426727 - DNA, 27 bp, Artificial Sequence
  Description of Artificial Sequence: Synthetic oligonucleotide
ggtgtctggggttgggaggctcagtat

SEQ ID NO: 426728 - DNA, 28 bp, Artificial Sequence
  Description of Artificial Sequence: Synthetic oligonucleotide
gtgtctggggttgggaggctcagtattg

SEQ ID NO: 426729 - DNA, 29 bp, Artificial Sequence
  Description of Artificial Sequence: Synthetic oligonucleotide
tgtctggggttgggaggctcagtattgag

SEQ ID NO: 426730 - DNA, 28 bp, Artificial Sequence
  Description of Artificial Sequence: Synthetic oligonucleotide
gtctggggttgggaggctcagtattgag

SEQ ID NO: 426731 - DNA, 32 bp, Artificial Sequence
  Description of Artificial Sequence: Synthetic oligonucleotide
tctggggttgggaggctcagtattgagaattc

SEQ ID NO: 426732 - DNA, 31 bp, Artificial Sequence
  Description of Artificial Sequence: Synthetic oligonucleotide
ctggggttgggaggctcagtattgagaattc

SEQ ID NO: 426733 - DNA, 31 bp, Artificial Sequence
  Description of Artificial Sequence: Synthetic oligonucleotide
tggggttgggaggctcagtattgagaattcc

SEQ ID NO: 426734 - DNA, 30 bp, Artificial Sequence
  Description of Artificial Sequence: Synthetic oligonucleotide
ggggttgggaggctcagtattgagaattcc

SEQ ID NO: 426735 - DNA, 30 bp, Artificial Sequence
  Description of Artificial Sequence: Synthetic oligonucleotide
gggttgggaggctcagtattgagaattccc

SEQ ID NO: 426736 - DNA, 30 bp, Artificial Sequence
  Description of Artificial Sequence: Synthetic oligonucleotide
ggttgggaggctcagtattgagaattcccc

SEQ ID NO: 426737 - DNA, 32 bp, Artificial Sequence
  Description of Artificial Sequence: Synthetic oligonucleotide
gttgggaggctcagtattgagaattccccatc

SEQ ID NO: 426738 - DNA, 33 bp, Artificial Sequence
  Description of Artificial Sequence: Synthetic oligonucleotide
ttgggaggctcagtattgagaattccccatctc

SEQ ID NO: 426739 - DNA, 32 bp, Artificial Sequence
  Description of Artificial Sequence: Synthetic oligonucleotide
tgggaggctcagtattgagaattccccatctc

SEQ ID NO: 426740 - DNA, 31 bp, Artificial Sequence
  Description of Artificial Sequence: Synthetic oligonucleotide
gggaggctcagtattgagaattccccatctc

SEQ ID NO: 426741 - DNA, 31 bp, Artificial Sequence
  Description of Artificial Sequence: Synthetic oligonucleotide
ggaggctcagtattgagaattccccatctcc

SEQ ID NO: 426742 - DNA, 31 bp, Artificial Sequence
  Description of Artificial Sequence: Synthetic oligonucleotide
gaggctcagtattgagaattccccatctccc

SEQ ID NO: 426743 - DNA, 27 bp, Artificial Sequence
  Description of Artificial Sequence: Synthetic oligonucleotide
ctctcccaacccgtgtcaggtccttct

SEQ ID NO: 426744 - DNA, 28 bp, Artificial Sequence
  Description of Artificial Sequence: Synthetic oligonucleotide
tctcccaacccgtgtcaggtccttcttc

SEQ ID NO: 426745 - DNA, 27 bp, Artificial Sequence
  Description of Artificial Sequence: Synthetic oligonucleotide
ctcccaacccgtgtcaggtccttcttc

SEQ ID NO: 426746 - DNA, 27 bp, Artificial Sequence
  Description of Artificial Sequence: Synthetic oligonucleotide
tcccaacccgtgtcaggtccttcttcc

SEQ ID NO: 426747 - DNA, 27 bp, Artificial Sequence
  Description of Artificial Sequence: Synthetic oligonucleotide
cccaacccgtgtcaggtccttcttcct

SEQ ID NO: 426748 - DNA, 27 bp, Artificial Sequence
  Description of Artificial Sequence: Synthetic oligonucleotide
ccaacccgtgtcaggtccttcttcctg

SEQ ID NO: 426749 - DNA, 27 bp, Artificial Sequence
  Description of Artificial Sequence: Synthetic oligonucleotide
caacccgtgtcaggtccttcttcctgg

SEQ ID NO: 426750 - DNA, 30 bp, Artificial Sequence
  Description of Artificial Sequence: Synthetic oligonucleotide
aacccgtgtcaggtccttcttcctggatac

SEQ ID NO: 426751 - DNA, 29 bp, Artificial Sequence
  Description of Artificial Sequence: Synthetic oligonucleotide
acccgtgtcaggtccttcttcctggatac

SEQ ID NO: 426752 - DNA, 28 bp, Artificial Sequence
  Description of Artificial Sequence: Synthetic oligonucleotide
cccgtgtcaggtccttcttcctggatac

SEQ ID NO: 426753 - DNA, 29 bp, Artificial Sequence
  Description of Artificial Sequence: Synthetic oligonucleotide
ccgtgtcaggtccttcttcctggatactc

SEQ ID NO: 426754 - DNA, 33 bp, Artificial Sequence
  Description of Artificial Sequence: Synthetic oligonucleotide
cgtgtcaggtccttcttcctggatactcataac

SEQ ID NO: 426755 - DNA, 33 bp, Artificial Sequence
  Description of Artificial Sequence: Synthetic oligonucleotide
gtgtcaggtccttcttcctggatactcataacg

SEQ ID NO: 426756 - DNA, 33 bp, Artificial Sequence
  Description of Artificial Sequence: Synthetic oligonucleotide
tgtcaggtccttcttcctggatactcataacgc

SEQ ID NO: 426757 - DNA, 32 bp, Artificial Sequence
  Description of Artificial Sequence: Synthetic oligonucleotide
gtcaggtccttcttcctggatactcataacgc

SEQ ID NO: 426758 - DNA, 32 bp, Artificial Sequence
  Description of Artificial Sequence: Synthetic oligonucleotide
tcaggtccttcttcctggatactcataacgcg

SEQ ID NO: 426759 - DNA, 31 bp, Artificial Sequence
  Description of Artificial Sequence: Synthetic oligonucleotide
caggtccttcttcctggatactcataacgcg

SEQ ID NO: 426760 - DNA, 31 bp, Artificial Sequence
  Description of Artificial Sequence: Synthetic oligonucleotide
aggtccttcttcctggatactcataacgcgg

SEQ ID NO: 426761 - DNA, 30 bp, Artificial Sequence
  Description of Artificial Sequence: Synthetic oligonucleotide
ggtccttcttcctggatactcataacgcgg

SEQ ID NO: 426762 - DNA, 30 bp, Artificial Sequence
  Description of Artificial Sequence: Synthetic oligonucleotide
gtccttcttcctggatactcataacgcggc

SEQ ID NO: 426763 - DNA, 30 bp, Artificial Sequence
  Description of Artificial Sequence: Synthetic oligonucleotide
tccttcttcctggatactcataacgcggcc

SEQ ID NO: 426764 - DNA, 29 bp, Artificial Sequence
  Description of Artificial Sequence: Synthetic oligonucleotide
ccttcttcctggatactcataacgcggcc

SEQ ID NO: 426765 - DNA, 29 bp, Artificial Sequence
  Description of Artificial Sequence: Synthetic oligonucleotide
cttcttcctggatactcataacgcggccc

SEQ ID NO: 426766 - DNA, 29 bp, Artificial Sequence
  Description of Artificial Sequence: Synthetic oligonucleotide
ttcttcctggatactcataacgcggcccc

SEQ ID NO: 426767 - DNA, 28 bp, Artificial Sequence
  Description of Artificial Sequence: Synthetic oligonucleotide
tcttcctggatactcataacgcggcccc

SEQ ID NO: 426768 - DNA, 27 bp, Artificial Sequence
  Description of Artificial Sequence: Synthetic oligonucleotide
cttcctggatactcataacgcggcccc

SEQ ID NO: 426769 - DNA, 31 bp, Artificial Sequence
  Description of Artificial Sequence: Synthetic oligonucleotide
ttcctggatactcataacgcggccccatttc

SEQ ID NO: 426770 - DNA, 30 bp, Artificial Sequence
  Description of Artificial Sequence: Synthetic oligonucleotide
aacccgtgtcaggtccttcttcctggttac

SEQ ID NO: 426771 - DNA, 29 bp, Artificial Sequence
  Description of Artificial Sequence: Synthetic oligonucleotide
acccgtgtcaggtccttcttcctggttac

SEQ ID NO: 426772 - DNA, 28 bp, Artificial Sequence
  Description of Artificial Sequence: Synthetic oligonucleotide
cccgtgtcaggtccttcttcctggttac

SEQ ID NO: 426773 - DNA, 29 bp, Artificial Sequence
  Description of Artificial Sequence: Synthetic oligonucleotide
ccgtgtcaggtccttcttcctggttactc

SEQ ID NO: 426774 - DNA, 33 bp, Artificial Sequence
  Description of Artificial Sequence: Synthetic oligonucleotide
cgtgtcaggtccttcttcctggttactcataac

SEQ ID NO: 426775 - DNA, 33 bp, Artificial Sequence
  Description of Artificial Sequence: Synthetic oligonucleotide
gtgtcaggtccttcttcctggttactcataacg

SEQ ID NO: 426776 - DNA, 33 bp, Artificial Sequence
  Description of Artificial Sequence: Synthetic oligonucleotide
tgtcaggtccttcttcctggttactcataacgc

SEQ ID NO: 426777 - DNA, 32 bp, Artificial Sequence
  Description of Artificial Sequence: Synthetic oligonucleotide
gtcaggtccttcttcctggttactcataacgc

SEQ ID NO: 426778 - DNA, 32 bp, Artificial Sequence
  Description of Artificial Sequence: Synthetic oligonucleotide
tcaggtccttcttcctggttactcataacgcg

SEQ ID NO: 426779 - DNA, 31 bp, Artificial Sequence
  Description of Artificial Sequence: Synthetic oligonucleotide
caggtccttcttcctggttactcataacgcg

SEQ ID NO: 426780 - DNA, 31 bp, Artificial Sequence
  Description of Artificial Sequence: Synthetic oligonucleotide
aggtccttcttcctggttactcataacgcgg

SEQ ID NO: 426781 - DNA, 30 bp, Artificial Sequence
  Description of Artificial Sequence: Synthetic oligonucleotide
ggtccttcttcctggttactcataacgcgg

SEQ ID NO: 426782 - DNA, 30 bp, Artificial Sequence
  Description of Artificial Sequence: Synthetic oligonucleotide
gtccttcttcctggttactcataacgcggc

SEQ ID NO: 426783 - DNA, 30 bp, Artificial Sequence
  Description of Artificial Sequence: Synthetic oligonucleotide
tccttcttcctggttactcataacgcggcc

SEQ ID NO: 426784 - DNA, 29 bp, Artificial Sequence
  Description of Artificial Sequence: Synthetic oligonucleotide
ccttcttcctggttactcataacgcggcc

SEQ ID NO: 426785 - DNA, 29 bp, Artificial Sequence
  Description of Artificial Sequence: Synthetic oligonucleotide
cttcttcctggttactcataacgcggccc

SEQ ID NO: 426786 - DNA, 29 bp, Artificial Sequence
  Description of Artificial Sequence: Synthetic oligonucleotide
ttcttcctggttactcataacgcggcccc

SEQ ID NO: 426787 - DNA, 28 bp, Artificial Sequence
  Description of Artificial Sequence: Synthetic oligonucleotide
tcttcctggttactcataacgcggcccc

SEQ ID NO: 426788 - DNA, 27 bp, Artificial Sequence
  Description of Artificial Sequence: Synthetic oligonucleotide
cttcctggttactcataacgcggcccc

SEQ ID NO: 426789 - DNA, 31 bp, Artificial Sequence
  Description of Artificial Sequence: Synthetic oligonucleotide
ttcctggttactcataacgcggccccatttc

SEQ ID NO: 426790 - DNA, 30 bp, Artificial Sequence
  Description of Artificial Sequence: Synthetic oligonucleotide
tcctggttactcataacgcggccccatttc

SEQ ID NO: 426791 - DNA, 29 bp, Artificial Sequence
  Description of Artificial Sequence: Synthetic oligonucleotide
cctggttactcataacgcggccccatttc

SEQ ID NO: 426792 - DNA, 30 bp, Artificial Sequence
  Description of Artificial Sequence: Synthetic oligonucleotide
ctggttactcataacgcggccccatttctc

SEQ ID NO: 426793 - DNA, 31 bp, Artificial Sequence
  Description of Artificial Sequence: Synthetic oligonucleotide
tggttactcataacgcggccccatttctcac

SEQ ID NO: 426794 - DNA, 30 bp, Artificial Sequence
  Description of Artificial Sequence: Synthetic oligonucleotide
ggttactcataacgcggccccatttctcac

SEQ ID NO: 426795 - DNA, 31 bp, Artificial Sequence
  Description of Artificial Sequence: Synthetic oligonucleotide
gttactcataacgcggccccatttctcactc

SEQ ID NO: 426796 - DNA, 31 bp, Artificial Sequence
  Description of Artificial Sequence: Synthetic oligonucleotide
ttactcataacgcggccccatttctcactcc

SEQ ID NO: 426797 - DNA, 27 bp, Artificial Sequence
  Description of Artificial Sequence: Synthetic oligonucleotide
ccatttctcactcccattgggcgtcgg

SEQ ID NO: 426798 - DNA, 27 bp, Artificial Sequence
  Description of Artificial Sequence: Synthetic oligonucleotide
catttctcactcccattgggcgtcggg

SEQ ID NO: 426799 - DNA, 30 bp, Artificial Sequence
  Description of Artificial Sequence: Synthetic oligonucleotide
atttctcactcccattgggcgtcgggtttc

SEQ ID NO: 426800 - DNA, 29 bp, Artificial Sequence
  Description of Artificial Sequence: Synthetic oligonucleotide
tttctcactcccattgggcgtcgggtttc

SEQ ID NO: 426801 - DNA, 28 bp, Artificial Sequence
  Description of Artificial Sequence: Synthetic oligonucleotide
ttctcactcccattgggcgtcgggtttc

SEQ ID NO: 426802 - DNA, 27 bp, Artificial Sequence
  Description of Artificial Sequence: Synthetic oligonucleotide
tctcactcccattgggcgtcgggtttc

SEQ ID NO: 426803 - DNA, 27 bp, Artificial Sequence
  Description of Artificial Sequence: Synthetic oligonucleotide
ctcactcccattgggcgtcgggtttct

SEQ ID NO: 426804 - DNA, 28 bp, Artificial Sequence
  Description of Artificial Sequence: Synthetic oligonucleotide
tcactcccattgggcgtcgggtttctag

SEQ ID NO: 426805 - DNA, 27 bp, Artificial Sequence
  Description of Artificial Sequence: Synthetic oligonucleotide
cactcccattgggcgtcgggtttctag

SEQ ID NO: 426806 - DNA, 28 bp, Artificial Sequence
  Description of Artificial Sequence: Synthetic oligonucleotide
actcccattgggcgtcgggtttctagag

SEQ ID NO: 426807 - DNA, 27 bp, Artificial Sequence
  Description of Artificial Sequence: Synthetic oligonucleotide
ctcccattgggcgtcgggtttctagag

SEQ ID NO: 426808 - DNA, 29 bp, Artificial Sequence
  Description of Artificial Sequence: Synthetic oligonucleotide
tcccattgggcgtcgggtttctagagaag

SEQ ID NO: 426809 - DNA, 28 bp, Artificial Sequence
  Description of Artificial Sequence: Synthetic oligonucleotide
cccattgggcgtcgggtttctagagaag

SEQ ID NO: 426810 - DNA, 28 bp, Artificial Sequence
  Description of Artificial Sequence: Synthetic oligonucleotide
ccattgggcgtcgggtttctagagaagc

SEQ ID NO: 426811 - DNA, 28 bp, Artificial Sequence
  Description of Artificial Sequence: Synthetic oligonucleotide
cattgggcgtcgggtttctagagaagcc

SEQ ID NO: 426812 - DNA, 31 bp, Artificial Sequence
  Description of Artificial Sequence: Synthetic oligonucleotide
attgggcgtcgggtttctagagaagccaatc

SEQ ID NO: 426813 - DNA, 30 bp, Artificial Sequence
  Description of Artificial Sequence: Synthetic oligonucleotide
ttgggcgtcgggtttctagagaagccaatc

SEQ ID NO: 426814 - DNA, 29 bp, Artificial Sequence
  Description of Artificial Sequence: Synthetic oligonucleotide
tgggcgtcgggtttctagagaagccaatc

SEQ ID NO: 426815 - DNA, 28 bp, Artificial Sequence
  Description of Artificial Sequence: Synthetic oligonucleotide
gggcgtcgggtttctagagaagccaatc

SEQ ID NO: 426816 - DNA, 29 bp, Artificial Sequence
  Description of Artificial Sequence: Synthetic oligonucleotide
ggcgtcgggtttctagagaagccaatcag

SEQ ID NO: 426817 - DNA, 30 bp, Artificial Sequence
  Description of Artificial Sequence: Synthetic oligonucleotide
gcgtcgggtttctagagaagccaatcagtg

SEQ ID NO: 426818 - DNA, 31 bp, Artificial Sequence
  Description of Artificial Sequence: Synthetic oligonucleotide
cgtcgggtttctagagaagccaatcagtgtc

SEQ ID NO: 426819 - DNA, 31 bp, Artificial Sequence
  Description of Artificial Sequence: Synthetic oligonucleotide
gtcgggtttctagagaagccaatcagtgtcg

SEQ ID NO: 426820 - DNA, 31 bp, Artificial Sequence
  Description of Artificial Sequence: Synthetic oligonucleotide
tcgggtttctagagaagccaatcagtgtcgc

SEQ ID NO: 426821 - DNA, 30 bp, Artificial Sequence
  Description of Artificial Sequence: Synthetic oligonucleotide
cgggtttctagagaagccaatcagtgtcgc

SEQ ID NO: 426822 - DNA, 30 bp, Artificial Sequence
  Description of Artificial Sequence: Synthetic oligonucleotide
gggtttctagagaagccaatcagtgtcgcc

SEQ ID NO: 426823 - DNA, 30 bp, Artificial Sequence
  Description of Artificial Sequence: Synthetic oligonucleotide
ggtttctagagaagccaatcagtgtcgccg

SEQ ID NO: 426824 - DNA, 25 bp, Artificial Sequence
  Description of Artificial Sequence: Synthetic oligonucleotide
cctggccctgaccgatacttgggca

SEQ ID NO: 426825 - DNA, 25 bp, Artificial Sequence
  Description of Artificial Sequence: Synthetic oligonucleotide
ctggccctgaccgatacttgggcag

SEQ ID NO: 426826 - DNA, 25 bp, Artificial Sequence
  Description of Artificial Sequence: Synthetic oligonucleotide
tggccctgaccgatacttgggcagg

SEQ ID NO: 426827 - DNA, 24 bp, Artificial Sequence
  Description of Artificial Sequence: Synthetic oligonucleotide
ggccctgaccgatacttgggcagg

SEQ ID NO: 426828 - DNA, 25 bp, Artificial Sequence
  Description of Artificial Sequence: Synthetic oligonucleotide
gccctgaccgatacttgggcaggct

SEQ ID NO: 426829 - DNA, 25 bp, Artificial Sequence
  Description of Artificial Sequence: Synthetic oligonucleotide
ccctgaccgatacttgggcaggctc

SEQ ID NO: 426830 - DNA, 25 bp, Artificial Sequence
  Description of Artificial Sequence: Synthetic oligonucleotide
cctgaccgatacttgggcaggctcc

SEQ ID NO: 426831 - DNA, 26 bp, Artificial Sequence
  Description of Artificial Sequence: Synthetic oligonucleotide
ctgaccgatacttgggcaggctccca

SEQ ID NO: 426832 - DNA, 27 bp, Artificial Sequence
  Description of Artificial Sequence: Synthetic oligonucleotide
tgaccgatacttgggcaggctcccact

SEQ ID NO: 426833 - DNA, 26 bp, Artificial Sequence
  Description of Artificial Sequence: Synthetic oligonucleotide
gaccgatacttgggcaggctcccact

SEQ ID NO: 426834 - DNA, 26 bp, Artificial Sequence
  Description of Artificial Sequence: Synthetic oligonucleotide
accgatacttgggcaggctcccactc

SEQ ID NO: 426835 - DNA, 25 bp, Artificial Sequence
  Description of Artificial Sequence: Synthetic oligonucleotide
ccgatacttgggcaggctcccactc

SEQ ID NO: 426836 - DNA, 27 bp, Artificial Sequence
  Description of Artificial Sequence: Synthetic oligonucleotide
cgatacttgggcaggctcccactcctt

SEQ ID NO: 426837 - DNA, 27 bp, Artificial Sequence
  Description of Artificial Sequence: Synthetic oligonucleotide
gatacttgggcaggctcccactccttg

SEQ ID NO: 426838 - DNA, 28 bp, Artificial Sequence
  Description of Artificial Sequence: Synthetic oligonucleotide
atacttgggcaggctcccactccttgag

SEQ ID NO: 426839 - DNA, 27 bp, Artificial Sequence
  Description of Artificial Sequence: Synthetic oligonucleotide
tacttgggcaggctcccactccttgag

SEQ ID NO: 426840 - DNA, 26 bp, Artificial Sequence
  Description of Artificial Sequence: Synthetic oligonucleotide
acttgggcaggctcccactccttgag

SEQ ID NO: 426841 - DNA, 25 bp, Artificial Sequence
  Description of Artificial Sequence: Synthetic oligonucleotide
cttgggcaggctcccactccttgag

SEQ ID NO: 426842 - DNA, 27 bp, Artificial Sequence
  Description of Artificial Sequence: Synthetic oligonucleotide
ttgggcaggctcccactccttgaggta

SEQ ID NO: 426843 - DNA, 27 bp, Artificial Sequence
  Description of Artificial Sequence: Synthetic oligonucleotide
tgggcaggctcccactccttgaggtat

SEQ ID NO: 426844 - DNA, 27 bp, Artificial Sequence
  Description of Artificial Sequence: Synthetic oligonucleotide
gggcaggctcccactccttgaggtatt

SEQ ID NO: 426845 - DNA, 28 bp, Artificial Sequence
  Description of Artificial Sequence: Synthetic oligonucleotide
ggcaggctcccactccttgaggtatttc

SEQ ID NO: 426846 - DNA, 29 bp, Artificial Sequence
  Description of Artificial Sequence: Synthetic oligonucleotide
gcaggctcccactccttgaggtatttcag

SEQ ID NO: 426847 - DNA, 29 bp, Artificial Sequence
  Description of Artificial Sequence: Synthetic oligonucleotide
caggctcccactccttgaggtatttcagc

SEQ ID NO: 426848 - DNA, 30 bp, Artificial Sequence; identical to SEQ ID NO: 77275
  Description of Artificial Sequence: Synthetic oligonucleotide

SEQ ID NO: 426849 - DNA, 28 bp, Artificial Sequence
  Description of Artificial Sequence: Synthetic oligonucleotide
tctcaggctgcagtcactgacagtgctc

SEQ ID NO: 426850 - DNA, 27 bp, Artificial Sequence
  Description of Artificial Sequence: Synthetic oligonucleotide
ctcaggctgcagtcactgacagtgctc

SEQ ID NO: 426851 - DNA, 28 bp, Artificial Sequence
  Description of Artificial Sequence: Synthetic oligonucleotide
tcaggctgcagtcactgacagtgctcag

SEQ ID NO: 426852 - DNA, 27 bp, Artificial Sequence
  Description of Artificial Sequence: Synthetic oligonucleotide
caggctgcagtcactgacagtgctcag

SEQ ID NO: 426853 - DNA, 27 bp, Artificial Sequence
  Description of Artificial Sequence: Synthetic oligonucleotide
aggctgcagtcactgacagtgctcagg

SEQ ID NO: 426854 - DNA, 26 bp, Artificial Sequence
  Description of Artificial Sequence: Synthetic oligonucleotide
ggctgcagtcactgacagtgctcagg

SEQ ID NO: 426855 - DNA, 26 bp, Artificial Sequence
  Description of Artificial Sequence: Synthetic oligonucleotide
gctgcagtcactgacagtgctcaggg

SEQ ID NO: 426856 - DNA, 27 bp, Artificial Sequence
  Description of Artificial Sequence: Synthetic oligonucleotide
ctgcagtcactgacagtgctcagggct

SEQ ID NO: 426857 - DNA, 27 bp, Artificial Sequence
  Description of Artificial Sequence: Synthetic oligonucleotide
tgcagtcactgacagtgctcagggctc

SEQ ID NO: 426858 - DNA, 27 bp, Artificial Sequence
  Description of Artificial Sequence: Synthetic oligonucleotide
gcagtcactgacagtgctcagggctct

SEQ ID NO: 426859 - DNA, 27 bp, Artificial Sequence
  Description of Artificial Sequence: Synthetic oligonucleotide
cagtcactgacagtgctcagggctctg

SEQ ID NO: 426860 - DNA, 27 bp, Artificial Sequence
  Description of Artificial Sequence: Synthetic oligonucleotide
agtcactgacagtgctcagggctctgg

SEQ ID NO: 426861 - DNA, 26 bp, Artificial Sequence
  Description of Artificial Sequence: Synthetic oligonucleotide
gtcactgacagtgctcagggctctgg

SEQ ID NO: 426862 - DNA, 26 bp, Artificial Sequence
  Description of Artificial Sequence: Synthetic oligonucleotide
tcactgacagtgctcagggctctggg

SEQ ID NO: 426863 - DNA, 25 bp, Artificial Sequence
  Description of Artificial Sequence: Synthetic oligonucleotide
cactgacagtgctcagggctctggg

SEQ ID NO: 426864 - DNA, 26 bp, Artificial Sequence
  Description of Artificial Sequence: Synthetic oligonucleotide
actgacagtgctcagggctctggggt

SEQ ID NO: 426865 - DNA, 25 bp, Artificial Sequence
  Description of Artificial Sequence: Synthetic oligonucleotide
ctgacagtgctcagggctctggggt

SEQ ID NO: 426866 - DNA, 26 bp, Artificial Sequence
  Description of Artificial Sequence: Synthetic oligonucleotide
tgacagtgctcagggctctggggtgt

SEQ ID NO: 426867 - DNA, 25 bp, Artificial Sequence
  Description of Artificial Sequence: Synthetic oligonucleotide
gacagtgctcagggctctggggtgt

SEQ ID NO: 426868 - DNA, 26 bp, Artificial Sequence
  Description of Artificial Sequence: Synthetic oligonucleotide
acagtgctcagggctctggggtgtct

SEQ ID NO: 426869 - DNA, 25 bp, Artificial Sequence
  Description of Artificial Sequence: Synthetic oligonucleotide
cagtgctcagggctctggggtgtct

SEQ ID NO: 426870 - DNA, 26 bp, Artificial Sequence
  Description of Artificial Sequence: Synthetic oligonucleotide
agtgctcagggctctggggtgtctct

SEQ ID NO: 426871 - DNA, 25 bp, Artificial Sequence
  Description of Artificial Sequence: Synthetic oligonucleotide
gtgctcagggctctggggtgtctct

SEQ ID NO: 426872 - DNA, 26 bp, Artificial Sequence
  Description of Artificial Sequence: Synthetic oligonucleotide
tgctcagggctctggggtgtctctca

SEQ ID NO: 426873 - DNA, 25 bp, Artificial Sequence
  Description of Artificial Sequence: Synthetic oligonucleotide
gctcagggctctggggtgtctctca

SEQ ID NO: 426874 - DNA, 26 bp, Artificial Sequence
  Description of Artificial Sequence: Synthetic oligonucleotide
ctcagggctctggggtgtctctcaca

SEQ ID NO: 426875 - DNA, 26 bp, Artificial Sequence
  Description of Artificial Sequence: Synthetic oligonucleotide
tcagggctctggggtgtctctcacag

SEQ ID NO: 426876 - DNA, 24 bp, Artificial Sequence
  Description of Artificial Sequence: Synthetic oligonucleotide
cctcctcctgctgctctcaggggt

SEQ ID NO: 426877 - DNA, 24 bp, Artificial Sequence
  Description of Artificial Sequence: Synthetic oligonucleotide
ctcctcctgctgctctcaggggtc

SEQ ID NO: 426878 - DNA, 25 bp, Artificial Sequence
  Description of Artificial Sequence: Synthetic oligonucleotide
tcctcctgctgctctcaggggtcct

SEQ ID NO: 426879 - DNA, 24 bp, Artificial Sequence
  Description of Artificial Sequence: Synthetic oligonucleotide
cctcctgctgctctcaggggtcct

SEQ ID NO: 426880 - DNA, 24 bp, Artificial Sequence
  Description of Artificial Sequence: Synthetic oligonucleotide
ctcctgctgctctcaggggtcctg

SEQ ID NO: 426881 - DNA, 24 bp, Artificial Sequence
  Description of Artificial Sequence: Synthetic oligonucleotide
tcctgctgctctcaggggtcctgg

SEQ ID NO: 426882 - DNA, 23 bp, Artificial Sequence
  Description of Artificial Sequence: Synthetic oligonucleotide
cctgctgctctcaggggtcctgg

SEQ ID NO: 426883 - DNA, 23 bp, Artificial Sequence
  Description of Artificial Sequence: Synthetic oligonucleotide
ctgctgctctcaggggtcctggc

SEQ ID NO: 426884 - DNA, 23 bp, Artificial Sequence
  Description of Artificial Sequence: Synthetic oligonucleotide
tgctgctctcaggggtcctggcc

SEQ ID NO: 426885 - DNA, 22 bp, Artificial Sequence
  Description of Artificial Sequence: Synthetic oligonucleotide
gctgctctcaggggtcctggcc

SEQ ID NO: 426886 - DNA, 23 bp, Artificial Sequence
  Description of Artificial Sequence: Synthetic oligonucleotide
ctgctctcaggggtcctggccct

SEQ ID NO: 426887 - DNA, 24 bp, Artificial Sequence
  Description of Artificial Sequence: Synthetic oligonucleotide
tgctctcaggggtcctggccctga

SEQ ID NO: 426888 - DNA, 23 bp, Artificial Sequence
  Description of Artificial Sequence: Synthetic oligonucleotide
gctctcaggggtcctggccctga

SEQ ID NO: 426889 - DNA, 23 bp, Artificial Sequence
  Description of Artificial Sequence: Synthetic oligonucleotide
ctctcaggggtcctggccctgac

SEQ ID NO: 426890 - DNA, 23 bp, Artificial Sequence
  Description of Artificial Sequence: Synthetic oligonucleotide
tctcaggggtcctggccctgacc

SEQ ID NO: 426891 - DNA, 22 bp, Artificial Sequence
  Description of Artificial Sequence: Synthetic oligonucleotide
ctcaggggtcctggccctgacc

SEQ ID NO: 426892 - DNA, 25 bp, Artificial Sequence
  Description of Artificial Sequence: Synthetic oligonucleotide
tcaggggtcctggccctgaccgata

SEQ ID NO: 426893 - DNA, 24 bp, Artificial Sequence
  Description of Artificial Sequence: Synthetic oligonucleotide
caggggtcctggccctgaccgata

SEQ ID NO: 426894 - DNA, 26 bp, Artificial Sequence
  Description of Artificial Sequence: Synthetic oligonucleotide
aggggtcctggccctgaccgatactt

SEQ ID NO: 426895 - DNA, 25 bp, Artificial Sequence
  Description of Artificial Sequence: Synthetic oligonucleotide
ggggtcctggccctgaccgatactt

SEQ ID NO: 426896 - DNA, 25 bp, Artificial Sequence
  Description of Artificial Sequence: Synthetic oligonucleotide
gggtcctggccctgaccgatacttg

SEQ ID NO: 426897 - DNA, 25 bp, Artificial Sequence
  Description of Artificial Sequence: Synthetic oligonucleotide
ggtcctggccctgaccgatacttgg

SEQ ID NO: 426898 - DNA, 25 bp, Artificial Sequence
  Description of Artificial Sequence: Synthetic oligonucleotide
gtcctggccctgaccgatacttggg

SEQ ID NO: 426899 - DNA, 25 bp, Artificial Sequence
  Description of Artificial Sequence: Synthetic oligonucleotide
tcctggccctgaccgatacttgggc

SEQ ID NO: 426900 - DNA, 24 bp, Artificial Sequence
  Description of Artificial Sequence: Synthetic oligonucleotide
aagtgggccgctgtggtggtgcct

SEQ ID NO: 426901 - DNA, 23 bp, Artificial Sequence
  Description of Artificial Sequence: Synthetic oligonucleotide
agtgggccgctgtggtggtgcct

SEQ ID NO: 426902 - DNA, 22 bp, Artificial Sequence
  Description of Artificial Sequence: Synthetic oligonucleotide
gtgggccgctgtggtggtgcct

SEQ ID NO: 426903 - DNA, 22 bp, Artificial Sequence
  Description of Artificial Sequence: Synthetic oligonucleotide
tgggccgctgtggtggtgcctc

SEQ ID NO: 426904 - DNA, 21 bp, Artificial Sequence
  Description of Artificial Sequence: Synthetic oligonucleotide
gggccgctgtggtggtgcctc

SEQ ID NO: 426905 - DNA, 22 bp, Artificial Sequence
  Description of Artificial Sequence: Synthetic oligonucleotide
ggccgctgtggtggtgcctcct

SEQ ID NO: 426906 - DNA, 22 bp, Artificial Sequence
  Description of Artificial Sequence: Synthetic oligonucleotide
gccgctgtggtggtgcctcctg

SEQ ID NO: 426907 - DNA, 23 bp, Artificial Sequence
  Description of Artificial Sequence: Synthetic oligonucleotide
ccgctgtggtggtgcctcctgga

SEQ ID NO: 426908 - DNA, 24 bp, Artificial Sequence
  Description of Artificial Sequence: Synthetic oligonucleotide
cgctgtggtggtgcctcctggaga

SEQ ID NO: 426909 - DNA, 24 bp, Artificial Sequence
  Description of Artificial Sequence: Synthetic oligonucleotide
gctgtggtggtgcctcctggagag

SEQ ID NO: 426910 - DNA, 26 bp, Artificial Sequence
  Description of Artificial Sequence: Synthetic oligonucleotide
ctgtggtggtgcctcctggagaggaa

SEQ ID NO: 426911 - DNA, 27 bp, Artificial Sequence
  Description of Artificial Sequence: Synthetic oligonucleotide
tgtggtggtgcctcctggagaggaaca

SEQ ID NO: 426912 - DNA, 26 bp, Artificial Sequence
  Description of Artificial Sequence: Synthetic oligonucleotide
gtggtggtgcctcctggagaggaaca

SEQ ID NO: 426913 - DNA, 27 bp, Artificial Sequence
  Description of Artificial Sequence: Synthetic oligonucleotide
tggtggtgcctcctggagaggaacaga

SEQ ID NO: 426914 - DNA, 26 bp, Artificial Sequence
  Description of Artificial Sequence: Synthetic oligonucleotide
ggtggtgcctcctggagaggaacaga

SEQ ID NO: 426915 - DNA, 27 bp, Artificial Sequence
  Description of Artificial Sequence: Synthetic oligonucleotide
gtggtgcctcctggagaggaacagaga

SEQ ID NO: 426916 - DNA, 29 bp, Artificial Sequence
  Description of Artificial Sequence: Synthetic oligonucleotide
tggtgcctcctggagaggaacagagatac

SEQ ID NO: 426917 - DNA, 28 bp, Artificial Sequence
  Description of Artificial Sequence: Synthetic oligonucleotide
ggtgcctcctggagaggaacagagatac

SEQ ID NO: 426918 - DNA, 29 bp, Artificial Sequence
  Description of Artificial Sequence: Synthetic oligonucleotide
gtgcctcctggagaggaacagagatacac

SEQ ID NO: 426919 - DNA, 31 bp, Artificial Sequence; identical to SEQ ID NO: 77346
  Description of Artificial Sequence: Synthetic oligonucleotide

SEQ ID NO: 426920 - DNA, 30 bp, Artificial Sequence; identical to SEQ ID NO: 77347
  Description of Artificial Sequence: Synthetic oligonucleotide

SEQ ID NO: 426921 - DNA, 30 bp, Artificial Sequence; identical to SEQ ID NO: 77348
  Description of Artificial Sequence: Synthetic oligonucleotide

SEQ ID NO: 426922 - DNA, 30 bp, Artificial Sequence; identical to SEQ ID NO: 77349
  Description of Artificial Sequence: Synthetic oligonucleotide

SEQ ID NO: 426923 - DNA, 32 bp, Artificial Sequence; identical to SEQ ID NO: 77350
  Description of Artificial Sequence: Synthetic oligonucleotide

SEQ ID NO: 426924 - DNA, 31 bp, Artificial Sequence; identical to SEQ ID NO: 77351
  Description of Artificial Sequence: Synthetic oligonucleotide

SEQ ID NO: 426925 - DNA, 22 bp, Artificial Sequence
  Description of Artificial Sequence: Synthetic oligonucleotide
cgaggatggagccgcgggagca

SEQ ID NO: 426926 - DNA, 23 bp, Artificial Sequence
  Description of Artificial Sequence: Synthetic oligonucleotide
gaggatggagccgcgggagcagt

SEQ ID NO: 426927 - DNA, 23 bp, Artificial Sequence
  Description of Artificial Sequence: Synthetic oligonucleotide
aggatggagccgcgggagcagtg

SEQ ID NO: 426928 - DNA, 22 bp, Artificial Sequence
  Description of Artificial Sequence: Synthetic oligonucleotide
ggatggagccgcgggagcagtg

SEQ ID NO: 426929 - DNA, 22 bp, Artificial Sequence
  Description of Artificial Sequence: Synthetic oligonucleotide
gatggagccgcgggagcagtgg

SEQ ID NO: 426930 - DNA, 23 bp, Artificial Sequence
  Description of Artificial Sequence: Synthetic oligonucleotide
atggagccgcgggagcagtgggt

SEQ ID NO: 426931 - DNA, 22 bp, Artificial Sequence
  Description of Artificial Sequence: Synthetic oligonucleotide
tggagccgcgggagcagtgggt

SEQ ID NO: 426932 - DNA, 21 bp, Artificial Sequence
  Description of Artificial Sequence: Synthetic oligonucleotide
ggagccgcgggagcagtgggt

SEQ ID NO: 426933 - DNA, 21 bp, Artificial Sequence
  Description of Artificial Sequence: Synthetic oligonucleotide
gagccgcgggagcagtgggtg

SEQ ID NO: 426934 - DNA, 22 bp, Artificial Sequence
  Description of Artificial Sequence: Synthetic oligonucleotide
agccgcgggagcagtgggtgga

SEQ ID NO: 426935 - DNA, 21 bp, Artificial Sequence
  Description of Artificial Sequence: Synthetic oligonucleotide
gccgcgggagcagtgggtgga

SEQ ID NO: 426936 - DNA, 21 bp, Artificial Sequence
  Description of Artificial Sequence: Synthetic oligonucleotide
ccgcgggagcagtgggtggag

SEQ ID NO: 426937 - DNA, 23 bp, Artificial Sequence
  Description of Artificial Sequence: Synthetic oligonucleotide
cgcgggagcagtgggtggagcaa

SEQ ID NO: 426938 - DNA, 24 bp, Artificial Sequence
  Description of Artificial Sequence: Synthetic oligonucleotide
gcgggagcagtgggtggagcaaga

SEQ ID NO: 426939 - DNA, 24 bp, Artificial Sequence
  Description of Artificial Sequence: Synthetic oligonucleotide
cgggagcagtgggtggagcaagag

SEQ ID NO: 426940 - DNA, 24 bp, Artificial Sequence
  Description of Artificial Sequence: Synthetic oligonucleotide
gggagcagtgggtggagcaagagg

SEQ ID NO: 426941 - DNA, 24 bp, Artificial Sequence
  Description of Artificial Sequence: Synthetic oligonucleotide
ggagcagtgggtggagcaagaggg

SEQ ID NO: 426942 - DNA, 24 bp, Artificial Sequence
  Description of Artificial Sequence: Synthetic oligonucleotide
gagcagtgggtggagcaagagggg

SEQ ID NO: 426943 - DNA, 24 bp, Artificial Sequence
  Description of Artificial Sequence: Synthetic oligonucleotide
agcagtgggtggagcaagaggggc

SEQ ID NO: 426944 - DNA, 23 bp, Artificial Sequence
  Description of Artificial Sequence: Synthetic oligonucleotide
gcagtgggtggagcaagaggggc

SEQ ID NO: 426945 - DNA, 23 bp, Artificial Sequence
  Description of Artificial Sequence: Synthetic oligonucleotide
cagtgggtggagcaagaggggcc

SEQ ID NO: 426946 - DNA, 23 bp, Artificial Sequence
  Description of Artificial Sequence: Synthetic oligonucleotide
agtgggtggagcaagaggggccg

SEQ ID NO: 426947 - DNA, 30 bp, Artificial Sequence
  Description of Artificial Sequence: Synthetic oligonucleotide
tgagacagaacgcttggcacaagagtagcg

SEQ ID NO: 426948 - DNA, 29 bp, Artificial Sequence
  Description of Artificial Sequence: Synthetic oligonucleotide
gagacagaacgcttggcacaagagtagcg

SEQ ID NO: 426949 - DNA, 29 bp, Artificial Sequence
  Description of Artificial Sequence: Synthetic oligonucleotide
agacagaacgcttggcacaagagtagcgg

SEQ ID NO: 426950 - DNA, 28 bp, Artificial Sequence
  Description of Artificial Sequence: Synthetic oligonucleotide
gacagaacgcttggcacaagagtagcgg

SEQ ID NO: 426951 - DNA, 28 bp, Artificial Sequence
  Description of Artificial Sequence: Synthetic oligonucleotide
acagaacgcttggcacaagagtagcggg

SEQ ID NO: 426952 - DNA, 27 bp, Artificial Sequence
  Description of Artificial Sequence: Synthetic oligonucleotide
cagaacgcttggcacaagagtagcggg

SEQ ID NO: 426953 - DNA, 27 bp, Artificial Sequence
  Description of Artificial Sequence: Synthetic oligonucleotide
agaacgcttggcacaagagtagcgggg

SEQ ID NO: 426954 - DNA, 27 bp, Artificial Sequence
  Description of Artificial Sequence: Synthetic oligonucleotide
gaacgcttggcacaagagtagcggggt

SEQ ID NO: 426955 - DNA, 27 bp, Artificial Sequence
  Description of Artificial Sequence: Synthetic oligonucleotide
aacgcttggcacaagagtagcggggtc

SEQ ID NO: 426956 - DNA, 27 bp, Artificial Sequence
  Description of Artificial Sequence: Synthetic oligonucleotide
acgcttggcacaagagtagcggggtca

SEQ ID NO: 426957 - DNA, 26 bp, Artificial Sequence
  Description of Artificial Sequence: Synthetic oligonucleotide
cgcttggcacaagagtagcggggtca

SEQ ID NO: 426958 - DNA, 26 bp, Artificial Sequence
  Description of Artificial Sequence: Synthetic oligonucleotide
gcttggcacaagagtagcggggtcag

SEQ ID NO: 426959 - DNA, 26 bp, Artificial Sequence
  Description of Artificial Sequence: Synthetic oligonucleotide
cttggcacaagagtagcggggtcagg

SEQ ID NO: 426960 - DNA, 26 bp, Artificial Sequence
  Description of Artificial Sequence: Synthetic oligonucleotide
ttggcacaagagtagcggggtcaggg

SEQ ID NO: 426961 - DNA, 25 bp, Artificial Sequence
  Description of Artificial Sequence: Synthetic oligonucleotide
tggcacaagagtagcggggtcaggg

SEQ ID NO: 426962 - DNA, 24 bp, Artificial Sequence
  Description of Artificial Sequence: Synthetic oligonucleotide
ggcacaagagtagcggggtcaggg

SEQ ID NO: 426963 - DNA, 24 bp, Artificial Sequence
  Description of Artificial Sequence: Synthetic oligonucleotide
gcacaagagtagcggggtcagggc

SEQ ID NO: 426964 - DNA, 26 bp, Artificial Sequence
  Description of Artificial Sequence: Synthetic oligonucleotide
cacaagagtagcggggtcagggcgaa

SEQ ID NO: 426965 - DNA, 27 bp, Artificial Sequence
  Description of Artificial Sequence: Synthetic oligonucleotide
acaagagtagcggggtcagggcgaagt

SEQ ID NO: 426966 - DNA, 26 bp, Artificial Sequence
  Description of Artificial Sequence: Synthetic oligonucleotide
caagagtagcggggtcagggcgaagt

SEQ ID NO: 426967 - DNA, 26 bp, Artificial Sequence
  Description of Artificial Sequence: Synthetic oligonucleotide
aagagtagcggggtcagggcgaagtc

SEQ ID NO: 426968 - DNA, 25 bp, Artificial Sequence
  Description of Artificial Sequence: Synthetic oligonucleotide
agagtagcggggtcagggcgaagtc

SEQ ID NO: 426969 - DNA, 24 bp, Artificial Sequence
  Description of Artificial Sequence: Synthetic oligonucleotide
gagtagcggggtcagggcgaagtc

SEQ ID NO: 426970 - DNA, 24 bp, Artificial Sequence
  Description of Artificial Sequence: Synthetic oligonucleotide
agtagcggggtcagggcgaagtcc

SEQ ID NO: 426971 - DNA, 23 bp, Artificial Sequence
  Description of Artificial Sequence: Synthetic oligonucleotide
gtagcggggtcagggcgaagtcc

SEQ ID NO: 426972 - DNA, 24 bp, Artificial Sequence
  Description of Artificial Sequence: Synthetic oligonucleotide
tagcggggtcagggcgaagtccca

SEQ ID NO: 426973 - DNA, 23 bp, Artificial Sequence
  Description of Artificial Sequence: Synthetic oligonucleotide
agcggggtcagggcgaagtccca

SEQ ID NO: 426974 - DNA, 22 bp, Artificial Sequence
  Description of Artificial Sequence: Synthetic oligonucleotide
gcggggtcagggcgaagtccca

SEQ ID NO: 426975 - DNA, 22 bp, Artificial Sequence
  Description of Artificial Sequence: Synthetic oligonucleotide
cggggtcagggcgaagtcccag

SEQ ID NO: 426976 - DNA, 23 bp, Artificial Sequence
  Description of Artificial Sequence: Synthetic oligonucleotide
gtcagggcgaagtcccagggcct

SEQ ID NO: 426977 - DNA, 25 bp, Artificial Sequence
  Description of Artificial Sequence: Synthetic oligonucleotide
tcagggcgaagtcccagggcctcaa

SEQ ID NO: 426978 - DNA, 24 bp, Artificial Sequence
  Description of Artificial Sequence: Synthetic oligonucleotide
cagggcgaagtcccagggcctcaa

SEQ ID NO: 426979 - DNA, 24 bp, Artificial Sequence
  Description of Artificial Sequence: Synthetic oligonucleotide
agggcgaagtcccagggcctcaag

SEQ ID NO: 426980 - DNA, 23 bp, Artificial Sequence
  Description of Artificial Sequence: Synthetic oligonucleotide
gggcgaagtcccagggcctcaag

SEQ ID NO: 426981 - DNA, 23 bp, Artificial Sequence
  Description of Artificial Sequence: Synthetic oligonucleotide
ggcgaagtcccagggcctcaagc

SEQ ID NO: 426982 - DNA, 24 bp, Artificial Sequence
  Description of Artificial Sequence: Synthetic oligonucleotide
gcgaagtcccagggcctcaagcgt

SEQ ID NO: 426983 - DNA, 24 bp, Artificial Sequence
  Description of Artificial Sequence: Synthetic oligonucleotide
cgaagtcccagggcctcaagcgtg

SEQ ID NO: 426984 - DNA, 24 bp, Artificial Sequence
  Description of Artificial Sequence: Synthetic oligonucleotide
gaagtcccagggcctcaagcgtgg

SEQ ID NO: 426985 - DNA, 25 bp, Artificial Sequence
  Description of Artificial Sequence: Synthetic oligonucleotide
aagtcccagggcctcaagcgtggct

SEQ ID NO: 426986 - DNA, 24 bp, Artificial Sequence
  Description of Artificial Sequence: Synthetic oligonucleotide
agtcccagggcctcaagcgtggct

SEQ ID NO: 426987 - DNA, 23 bp, Artificial Sequence
  Description of Artificial Sequence: Synthetic oligonucleotide
gtcccagggcctcaagcgtggct

SEQ ID NO: 426988 - DNA, 24 bp, Artificial Sequence
  Description of Artificial Sequence: Synthetic oligonucleotide
tcccagggcctcaagcgtggctct

SEQ ID NO: 426989 - DNA, 23 bp, Artificial Sequence
  Description of Artificial Sequence: Synthetic oligonucleotide
cccagggcctcaagcgtggctct

SEQ ID NO: 426990 - DNA, 24 bp, Artificial Sequence
  Description of Artificial Sequence: Synthetic oligonucleotide
ccagggcctcaagcgtggctctca

SEQ ID NO: 426991 - DNA, 24 bp, Artificial Sequence
  Description of Artificial Sequence: Synthetic oligonucleotide
cagggcctcaagcgtggctctcag

SEQ ID NO: 426992 - DNA, 24 bp, Artificial Sequence
  Description of Artificial Sequence: Synthetic oligonucleotide
agggcctcaagcgtggctctcagg

SEQ ID NO: 426993 - DNA, 23 bp, Artificial Sequence
  Description of Artificial Sequence: Synthetic oligonucleotide
gggcctcaagcgtggctctcagg

SEQ ID NO: 426994 - DNA, 24 bp, Artificial Sequence
  Description of Artificial Sequence: Synthetic oligonucleotide
ggcctcaagcgtggctctcagggt

SEQ ID NO: 426995 - DNA, 25 bp, Artificial Sequence
  Description of Artificial Sequence: Synthetic oligonucleotide
gcctcaagcgtggctctcagggtct

SEQ ID NO: 426996 - DNA, 26 bp, Artificial Sequence
  Description of Artificial Sequence: Synthetic oligonucleotide
cctcaagcgtggctctcagggtctca

SEQ ID NO: 426997 - DNA, 26 bp, Artificial Sequence
  Description of Artificial Sequence: Synthetic oligonucleotide
ctcaagcgtggctctcagggtctcag

SEQ ID NO: 426998 - DNA, 26 bp, Artificial Sequence
  Description of Artificial Sequence: Synthetic oligonucleotide
tcaagcgtggctctcagggtctcagg

SEQ ID NO: 426999 - DNA, 25 bp, Artificial Sequence
  Description of Artificial Sequence: Synthetic oligonucleotide
caagcgtggctctcagggtctcagg

SEQ ID NO: 427000 - DNA, 25 bp, Artificial Sequence
  Description of Artificial Sequence: Synthetic oligonucleotide
aagcgtggctctcagggtctcaggc

SEQ ID NO: 427001 - DNA, 24 bp, Artificial Sequence
  Description of Artificial Sequence: Synthetic oligonucleotide
agcgtggctctcagggtctcaggc

SEQ ID NO: 427002 - DNA, 24 bp, Artificial Sequence
  Description of Artificial Sequence: Synthetic oligonucleotide
tggctctcagggtctcaggcccca

SEQ ID NO: 427003 - DNA, 23 bp, Artificial Sequence
  Description of Artificial Sequence: Synthetic oligonucleotide
ggctctcagggtctcaggcccca

SEQ ID NO: 427004 - DNA, 24 bp, Artificial Sequence
  Description of Artificial Sequence: Synthetic oligonucleotide
gctctcagggtctcaggccccaca

SEQ ID NO: 427005 - DNA, 24 bp, Artificial Sequence
  Description of Artificial Sequence: Synthetic oligonucleotide
ctctcagggtctcaggccccacag

SEQ ID NO: 427006 - DNA, 24 bp, Artificial Sequence
  Description of Artificial Sequence: Synthetic oligonucleotide
tctcagggtctcaggccccacagg

SEQ ID NO: 427007 - DNA, 23 bp, Artificial Sequence
  Description of Artificial Sequence: Synthetic oligonucleotide
ctcagggtctcaggccccacagg

SEQ ID NO: 427008 - DNA, 23 bp, Artificial Sequence
  Description of Artificial Sequence: Synthetic oligonucleotide
tcagggtctcaggccccacaggc

SEQ ID NO: 427009 - DNA, 22 bp, Artificial Sequence
  Description of Artificial Sequence: Synthetic oligonucleotide
cagggtctcaggccccacaggc

SEQ ID NO: 427010 - DNA, 22 bp, Artificial Sequence
  Description of Artificial Sequence: Synthetic oligonucleotide
agggtctcaggccccacaggcg

SEQ ID NO: 427011 - DNA, 21 bp, Artificial Sequence
  Description of Artificial Sequence: Synthetic oligonucleotide
gggtctcaggccccacaggcg

SEQ ID NO: 427012 - DNA, 22 bp, Artificial Sequence
  Description of Artificial Sequence: Synthetic oligonucleotide
ggtctcaggccccacaggcggt

SEQ ID NO: 427013 - DNA, 25 bp, Artificial Sequence
  Description of Artificial Sequence: Synthetic oligonucleotide
gtctcaggccccacaggcggtgtat

SEQ ID NO: 427014 - DNA, 25 bp, Artificial Sequence
  Description of Artificial Sequence: Synthetic oligonucleotide
tctcaggccccacaggcggtgtatg

SEQ ID NO: 427015 - DNA, 24 bp, Artificial Sequence
  Description of Artificial Sequence: Synthetic oligonucleotide
ctcaggccccacaggcggtgtatg

SEQ ID NO: 427016 - DNA, 24 bp, Artificial Sequence
  Description of Artificial Sequence: Synthetic oligonucleotide
tcaggccccacaggcggtgtatgg

SEQ ID NO: 427017 - DNA, 23 bp, Artificial Sequence
  Description of Artificial Sequence: Synthetic oligonucleotide
caggccccacaggcggtgtatgg

SEQ ID NO: 427018 - DNA, 25 bp, Artificial Sequence
  Description of Artificial Sequence: Synthetic oligonucleotide
aggccccacaggcggtgtatgggtt

SEQ ID NO: 427019 - DNA, 24 bp, Artificial Sequence
  Description of Artificial Sequence: Synthetic oligonucleotide
ggccccacaggcggtgtatgggtt

SEQ ID NO: 427020 - DNA, 24 bp, Artificial Sequence
  Description of Artificial Sequence: Synthetic oligonucleotide
gccccacaggcggtgtatgggttg

SEQ ID NO: 427021 - DNA, 24 bp, Artificial Sequence
  Description of Artificial Sequence: Synthetic oligonucleotide
ccccacaggcggtgtatgggttgg

SEQ ID NO: 427022 - DNA, 24 bp, Artificial Sequence
  Description of Artificial Sequence: Synthetic oligonucleotide
cccacaggcggtgtatgggttggg

SEQ ID NO: 427023 - DNA, 25 bp, Artificial Sequence
  Description of Artificial Sequence: Synthetic oligonucleotide
ccacaggcggtgtatgggttgggga

SEQ ID NO: 427024 - DNA, 25 bp, Artificial Sequence
  Description of Artificial Sequence: Synthetic oligonucleotide
cacaggcggtgtatgggttggggag

SEQ ID NO: 427025 - DNA, 25 bp, Artificial Sequence
  Description of Artificial Sequence: Synthetic oligonucleotide
acaggcggtgtatgggttggggagg

SEQ ID NO: 427026 - DNA, 24 bp, Artificial Sequence
  Description of Artificial Sequence: Synthetic oligonucleotide
caggcggtgtatgggttggggagg

SEQ ID NO: 427027 - DNA, 24 bp, Artificial Sequence
  Description of Artificial Sequence: Synthetic oligonucleotide
aggcggtgtatgggttggggaggc

SEQ ID NO: 427028 - DNA, 23 bp, Artificial Sequence
  Description of Artificial Sequence: Synthetic oligonucleotide
ggcggtgtatgggttggggaggc

SEQ ID NO: 427029 - DNA, 23 bp, Artificial Sequence
  Description of Artificial Sequence: Synthetic oligonucleotide
gcggtgtatgggttggggaggcc

SEQ ID NO: 427030 - DNA, 23 bp, Artificial Sequence
  Description of Artificial Sequence: Synthetic oligonucleotide
cggtgtatgggttggggaggccc

SEQ ID NO: 427031 - DNA, 23 bp, Artificial Sequence
  Description of Artificial Sequence: Synthetic oligonucleotide
ggtgtatgggttggggaggcccc

SEQ ID NO: 427032 - DNA, 23 bp, Artificial Sequence
  Description of Artificial Sequence: Synthetic oligonucleotide
gtgtatgggttggggaggccccg

SEQ ID NO: 427033 - DNA, 23 bp, Artificial Sequence
  Description of Artificial Sequence: Synthetic oligonucleotide
tgtatgggttggggaggccccgc

SEQ ID NO: 427034 - DNA, 22 bp, Artificial Sequence
  Description of Artificial Sequence: Synthetic oligonucleotide
gtatgggttggggaggccccgc

SEQ ID NO: 427035 - DNA, 24 bp, Artificial Sequence
  Description of Artificial Sequence: Synthetic oligonucleotide
tatgggttggggaggccccgcgtt

SEQ ID NO: 427036 - DNA, 23 bp, Artificial Sequence
  Description of Artificial Sequence: Synthetic oligonucleotide
atgggttggggaggccccgcgtt

SEQ ID NO: 427037 - DNA, 22 bp, Artificial Sequence
  Description of Artificial Sequence: Synthetic oligonucleotide
tgggttggggaggccccgcgtt

SEQ ID NO: 427038 - DNA, 21 bp, Artificial Sequence
  Description of Artificial Sequence: Synthetic oligonucleotide
gggttggggaggccccgcgtt

SEQ ID NO: 427039 - DNA, 21 bp, Artificial Sequence
  Description of Artificial Sequence: Synthetic oligonucleotide
ggttggggaggccccgcgttg

SEQ ID NO: 427040 - DNA, 21 bp, Artificial Sequence
  Description of Artificial Sequence: Synthetic oligonucleotide
gttggggaggccccgcgttgg

SEQ ID NO: 427041 - DNA, 21 bp, Artificial Sequence
  Description of Artificial Sequence: Synthetic oligonucleotide
ttggggaggccccgcgttggg

SEQ ID NO: 427042 - DNA, 20 bp, Artificial Sequence
  Description of Artificial Sequence: Synthetic oligonucleotide
tggggaggccccgcgttggg

SEQ ID NO: 427043 - DNA, 20 bp, Artificial Sequence
  Description of Artificial Sequence: Synthetic oligonucleotide
ggggaggccccgcgttgggt

SEQ ID NO: 427044 - DNA, 22 bp, Artificial Sequence
  Description of Artificial Sequence: Synthetic oligonucleotide
gggaggccccgcgttggggatt

SEQ ID NO: 427045 - DNA, 23 bp, Artificial Sequence
  Description of Artificial Sequence: Synthetic oligonucleotide
ggaggccccgcgttggggattct

SEQ ID NO: 427046 - DNA, 24 bp, Artificial Sequence
  Description of Artificial Sequence: Synthetic oligonucleotide
gaggccccgcgttggggattctct

SEQ ID NO: 427047 - DNA, 24 bp, Artificial Sequence
  Description of Artificial Sequence: Synthetic oligonucleotide
aggccccgcgttggggattctctc

SEQ ID NO: 427048 - DNA, 23 bp, Artificial Sequence
  Description of Artificial Sequence: Synthetic oligonucleotide
ggccccgcgttggggattctctc

SEQ ID NO: 427049 - DNA, 24 bp, Artificial Sequence
  Description of Artificial Sequence: Synthetic oligonucleotide
gccccgcgttggggattctctcct

SEQ ID NO: 427050 - DNA, 24 bp, Artificial Sequence
  Description of Artificial Sequence: Synthetic oligonucleotide
ccccgcgttggggattctctcctc

SEQ ID NO: 427051 - DNA, 26 bp, Artificial Sequence
  Description of Artificial Sequence: Synthetic oligonucleotide
cccgcgttggggattctctcctcctt

SEQ ID NO: 427052 - DNA, 27 bp, Artificial Sequence
  Description of Artificial Sequence: Synthetic oligonucleotide
ccgcgttggggattctctcctccttct

SEQ ID NO: 427053 - DNA, 27 bp, Artificial Sequence
  Description of Artificial Sequence: Synthetic oligonucleotide
cgcgttggggattctctcctccttctc

SEQ ID NO: 427054 - DNA, 27 bp, Artificial Sequence
  Description of Artificial Sequence: Synthetic oligonucleotide
gcgttggggattctctcctccttctcc

SEQ ID NO: 427055 - DNA, 30 bp, Artificial Sequence
  Description of Artificial Sequence: Synthetic oligonucleotide
cgttggggattctctcctccttctcctaac

SEQ ID NO: 427056 - DNA, 30 bp, Artificial Sequence
  Description of Artificial Sequence: Synthetic oligonucleotide
gttggggattctctcctccttctcctaacc

SEQ ID NO: 427057 - DNA, 31 bp, Artificial Sequence
  Description of Artificial Sequence: Synthetic oligonucleotide
ttggggattctctcctccttctcctaacctg

SEQ ID NO: 427058 - DNA, 30 bp, Artificial Sequence
  Description of Artificial Sequence: Synthetic oligonucleotide
tggggattctctcctccttctcctaacctg

SEQ ID NO: 427059 - DNA, 29 bp, Artificial Sequence
  Description of Artificial Sequence: Synthetic oligonucleotide
ggggattctctcctccttctcctaacctg

SEQ ID NO: 427060 - DNA, 30 bp, Artificial Sequence
  Description of Artificial Sequence: Synthetic oligonucleotide
gggattctctcctccttctcctaacctgtg

SEQ ID NO: 427061 - DNA, 31 bp, Artificial Sequence
  Description of Artificial Sequence: Synthetic oligonucleotide
ggattctctcctccttctcctaacctgtgtc

SEQ ID NO: 427062 - DNA, 31 bp, Artificial Sequence
  Description of Artificial Sequence: Synthetic oligonucleotide
gattctctcctccttctcctaacctgtgtcg

SEQ ID NO: 427063 - DNA, 31 bp, Artificial Sequence
  Description of Artificial Sequence: Synthetic oligonucleotide
attctctcctccttctcctaacctgtgtcgg

SEQ ID NO: 427064 - DNA, 30 bp, Artificial Sequence
  Description of Artificial Sequence: Synthetic oligonucleotide
ttctctcctccttctcctaacctgtgtcgg

SEQ ID NO: 427065 - DNA, 29 bp, Artificial Sequence
  Description of Artificial Sequence: Synthetic oligonucleotide
tctctcctccttctcctaacctgtgtcgg

SEQ ID NO: 427066 - DNA, 28 bp, Artificial Sequence
  Description of Artificial Sequence: Synthetic oligonucleotide
ctctcctccttctcctaacctgtgtcgg

SEQ ID NO: 427067 - DNA, 28 bp, Artificial Sequence
  Description of Artificial Sequence: Synthetic oligonucleotide
tctcctccttctcctaacctgtgtcggg

SEQ ID NO: 427068 - DNA, 27 bp, Artificial Sequence
  Description of Artificial Sequence: Synthetic oligonucleotide
ctcctccttctcctaacctgtgtcggg

SEQ ID NO: 427069 - DNA, 28 bp, Artificial Sequence
  Description of Artificial Sequence: Synthetic oligonucleotide
tcctccttctcctaacctgtgtcgggtc

SEQ ID NO: 427070 - DNA, 27 bp, Artificial Sequence
  Description of Artificial Sequence: Synthetic oligonucleotide
cctccttctcctaacctgtgtcgggtc

SEQ ID NO: 427071 - DNA, 27 bp, Artificial Sequence
  Description of Artificial Sequence: Synthetic oligonucleotide
ctccttctcctaacctgtgtcgggtcc

SEQ ID NO: 427072 - DNA, 29 bp, Artificial Sequence
  Description of Artificial Sequence: Synthetic oligonucleotide
tccttctcctaacctgtgtcgggtccttc

SEQ ID NO: 427073 - DNA, 28 bp, Artificial Sequence
  Description of Artificial Sequence: Synthetic oligonucleotide
ccttctcctaacctgtgtcgggtccttc

SEQ ID NO: 427074 - DNA, 30 bp, Artificial Sequence
  Description of Artificial Sequence: Synthetic oligonucleotide
cttctcctaacctgtgtcgggtccttcttc

SEQ ID NO: 427075 - DNA, 30 bp, Artificial Sequence
  Description of Artificial Sequence: Synthetic oligonucleotide
ttctcctaacctgtgtcgggtccttcttcc

SEQ ID NO: 427076 - DNA, 29 bp, Artificial Sequence
  Description of Artificial Sequence: Synthetic oligonucleotide
tctcctaacctgtgtcgggtccttcttcc

SEQ ID NO: 427077 - DNA, 28 bp, Artificial Sequence
  Description of Artificial Sequence: Synthetic oligonucleotide
ctcctaacctgtgtcgggtccttcttcc

SEQ ID NO: 427078 - DNA, 29 bp, Artificial Sequence
  Description of Artificial Sequence: Synthetic oligonucleotide
tcctaacctgtgtcgggtccttcttcctg

SEQ ID NO: 427079 - DNA, 28 bp, Artificial Sequence
  Description of Artificial Sequence: Synthetic oligonucleotide
cctaacctgtgtcgggtccttcttcctg

SEQ ID NO: 427080 - DNA, 28 bp, Artificial Sequence
  Description of Artificial Sequence: Synthetic oligonucleotide
ctaacctgtgtcgggtccttcttcctgg

SEQ ID NO: 427081 - DNA, 31 bp, Artificial Sequence
  Description of Artificial Sequence: Synthetic oligonucleotide
taacctgtgtcgggtccttcttcctggatac

SEQ ID NO: 427082 - DNA, 30 bp, Artificial Sequence
  Description of Artificial Sequence: Synthetic oligonucleotide
aacctgtgtcgggtccttcttcctggatac

SEQ ID NO: 427083 - DNA, 29 bp, Artificial Sequence
  Description of Artificial Sequence: Synthetic oligonucleotide
acctgtgtcgggtccttcttcctggatac

SEQ ID NO: 427084 - DNA, 28 bp, Artificial Sequence
  Description of Artificial Sequence: Synthetic oligonucleotide
cctgtgtcgggtccttcttcctggatac

SEQ ID NO: 427085 - DNA, 29 bp, Artificial Sequence
  Description of Artificial Sequence: Synthetic oligonucleotide
ctgtgtcgggtccttcttcctggatactc

SEQ ID NO: 427086 - DNA, 30 bp, Artificial Sequence
  Description of Artificial Sequence: Synthetic oligonucleotide
tgtgtcgggtccttcttcctggatactcac

SEQ ID NO: 427087 - DNA, 29 bp, Artificial Sequence
  Description of Artificial Sequence: Synthetic oligonucleotide
gtgtcgggtccttcttcctggatactcac

SEQ ID NO: 427088 - DNA, 29 bp, Artificial Sequence
  Description of Artificial Sequence: Synthetic oligonucleotide
tgtcgggtccttcttcctggatactcacc

SEQ ID NO: 427089 - DNA, 28 bp, Artificial Sequence
  Description of Artificial Sequence: Synthetic oligonucleotide
gtcgggtccttcttcctggatactcacc

SEQ ID NO: 427090 - DNA, 28 bp, Artificial Sequence
  Description of Artificial Sequence: Synthetic oligonucleotide
tcgggtccttcttcctggatactcaccg

SEQ ID NO: 427091 - DNA, 27 bp, Artificial Sequence
  Description of Artificial Sequence: Synthetic oligonucleotide
cgggtccttcttcctggatactcaccg

SEQ ID NO: 427092 - DNA, 27 bp, Artificial Sequence
  Description of Artificial Sequence: Synthetic oligonucleotide
gggtccttcttcctggatactcaccgg

SEQ ID NO: 427093 - DNA, 27 bp, Artificial Sequence
  Description of Artificial Sequence: Synthetic oligonucleotide
ggtccttcttcctggatactcaccggg

SEQ ID NO: 427094 - DNA, 27 bp, Artificial Sequence
  Description of Artificial Sequence: Synthetic oligonucleotide
gtccttcttcctggatactcaccgggc

SEQ ID NO: 427095 - DNA, 27 bp, Artificial Sequence
  Description of Artificial Sequence: Synthetic oligonucleotide
tccttcttcctggatactcaccgggcg

SEQ ID NO: 427096 - DNA, 26 bp, Artificial Sequence
  Description of Artificial Sequence: Synthetic oligonucleotide
ccttcttcctggatactcaccgggcg

SEQ ID NO: 427097 - DNA, 26 bp, Artificial Sequence
  Description of Artificial Sequence: Synthetic oligonucleotide
cttcttcctggatactcaccgggcgg

SEQ ID NO: 427098 - DNA, 26 bp, Artificial Sequence
  Description of Artificial Sequence: Synthetic oligonucleotide
ttcttcctggatactcaccgggcggc

SEQ ID NO: 427099 - DNA, 25 bp, Artificial Sequence
  Description of Artificial Sequence: Synthetic oligonucleotide
tcttcctggatactcaccgggcggc

SEQ ID NO: 427100 - DNA, 24 bp, Artificial Sequence
  Description of Artificial Sequence: Synthetic oligonucleotide
cttcctggatactcaccgggcggc

SEQ ID NO: 427101 - DNA, 24 bp, Artificial Sequence
  Description of Artificial Sequence: Synthetic oligonucleotide
ttcctggatactcaccgggcggcc

SEQ ID NO: 427102 - DNA, 23 bp, Artificial Sequence
  Description of Artificial Sequence: Synthetic oligonucleotide
tcctggatactcaccgggcggcc

SEQ ID NO: 427103 - DNA, 22 bp, Artificial Sequence
  Description of Artificial Sequence: Synthetic oligonucleotide
cctggatactcaccgggcggcc

SEQ ID NO: 427104 - DNA, 22 bp, Artificial Sequence
  Description of Artificial Sequence: Synthetic oligonucleotide
ctggatactcaccgggcggccc

SEQ ID NO: 427105 - DNA, 23 bp, Artificial Sequence
  Description of Artificial Sequence: Synthetic oligonucleotide
tggatactcaccgggcggcccca

SEQ ID NO: 427106 - DNA, 22 bp, Artificial Sequence
  Description of Artificial Sequence: Synthetic oligonucleotide
ggatactcaccgggcggcccca

SEQ ID NO: 427107 - DNA, 24 bp, Artificial Sequence
  Description of Artificial Sequence: Synthetic oligonucleotide
gatactcaccgggcggccccagtt

SEQ ID NO: 427108 - DNA, 25 bp, Artificial Sequence
  Description of Artificial Sequence: Synthetic oligonucleotide
atactcaccgggcggccccagttct

SEQ ID NO: 427109 - DNA, 24 bp, Artificial Sequence
  Description of Artificial Sequence: Synthetic oligonucleotide
tactcaccgggcggccccagttct

SEQ ID NO: 427110 - DNA, 23 bp, Artificial Sequence
  Description of Artificial Sequence: Synthetic oligonucleotide
actcaccgggcggccccagttct

SEQ ID NO: 427111 - DNA, 22 bp, Artificial Sequence
  Description of Artificial Sequence: Synthetic oligonucleotide
ctcaccgggcggccccagttct

SEQ ID NO: 427112 - DNA, 23 bp, Artificial Sequence
  Description of Artificial Sequence: Synthetic oligonucleotide
tcaccgggcggccccagttctca

SEQ ID NO: 427113 - DNA, 22 bp, Artificial Sequence
  Description of Artificial Sequence: Synthetic oligonucleotide
caccgggcggccccagttctca

SEQ ID NO: 427114 - DNA, 23 bp, Artificial Sequence
  Description of Artificial Sequence: Synthetic oligonucleotide
accgggcggccccagttctcact

SEQ ID NO: 427115 - DNA, 22 bp, Artificial Sequence
  Description of Artificial Sequence: Synthetic oligonucleotide
ccgggcggccccagttctcact

SEQ ID NO: 427116 - DNA, 22 bp, Artificial Sequence
  Description of Artificial Sequence: Synthetic oligonucleotide
cgggcggccccagttctcactc

SEQ ID NO: 427117 - DNA, 22 bp, Artificial Sequence
  Description of Artificial Sequence: Synthetic oligonucleotide
gggcggccccagttctcactcc

SEQ ID NO: 427118 - DNA, 26 bp, Artificial Sequence
  Description of Artificial Sequence: Synthetic oligonucleotide
ggcggccccagttctcactcccatta

SEQ ID NO: 427119 - DNA, 26 bp, Artificial Sequence
  Description of Artificial Sequence: Synthetic oligonucleotide
gcggccccagttctcactcccattag

SEQ ID NO: 427120 - DNA, 27 bp, Artificial Sequence
  Description of Artificial Sequence: Synthetic oligonucleotide
cggccccagttctcactcccattaggt

SEQ ID NO: 427121 - DNA, 27 bp, Artificial Sequence
  Description of Artificial Sequence: Synthetic oligonucleotide
ggccccagttctcactcccattaggtg

SEQ ID NO: 427122 - DNA, 28 bp, Artificial Sequence
  Description of Artificial Sequence: Synthetic oligonucleotide
gccccagttctcactcccattaggtgac

SEQ ID NO: 427123 - DNA, 29 bp, Artificial Sequence
  Description of Artificial Sequence: Synthetic oligonucleotide
ccccagttctcactcccattaggtgacag

SEQ ID NO: 427124 - DNA, 29 bp, Artificial Sequence
  Description of Artificial Sequence: Synthetic oligonucleotide
cccagttctcactcccattaggtgacagg

SEQ ID NO: 427125 - DNA, 35 bp, Artificial Sequence
  Description of Artificial Sequence: Synthetic oligonucleotide
ccagttctcactcccattaggtgacaggtttttag

SEQ ID NO: 427126 - DNA, 36 bp, Artificial Sequence
  Description of Artificial Sequence: Synthetic oligonucleotide
cagttctcactcccattaggtgacaggtttttagag

SEQ ID NO: 427127 - DNA, 38 bp, Artificial Sequence
  Description of Artificial Sequence: Synthetic oligonucleotide
agttctcactcccattaggtgacaggtttttagagaag

SEQ ID NO: 427128 - DNA, 37 bp, Artificial Sequence
  Description of Artificial Sequence: Synthetic oligonucleotide
gttctcactcccattaggtgacaggtttttagagaag

SEQ ID NO: 427129 - DNA, 37 bp, Artificial Sequence
  Description of Artificial Sequence: Synthetic oligonucleotide
ttctcactcccattaggtgacaggtttttagagaagc

SEQ ID NO: 427130 - DNA, 36 bp, Artificial Sequence
  Description of Artificial Sequence: Synthetic oligonucleotide
tctcactcccattaggtgacaggtttttagagaagc

SEQ ID NO: 427131 - DNA, 35 bp, Artificial Sequence
  Description of Artificial Sequence: Synthetic oligonucleotide
ctcactcccattaggtgacaggtttttagagaagc

SEQ ID NO: 427132 - DNA, 35 bp, Artificial Sequence
  Description of Artificial Sequence: Synthetic oligonucleotide
tcactcccattaggtgacaggtttttagagaagcc

SEQ ID NO: 427133 - DNA, 34 bp, Artificial Sequence
  Description of Artificial Sequence: Synthetic oligonucleotide
cactcccattaggtgacaggtttttagagaagcc

SEQ ID NO: 427134 - DNA, 37 bp, Artificial Sequence
  Description of Artificial Sequence: Synthetic oligonucleotide
actcccattaggtgacaggtttttagagaagccaatc

SEQ ID NO: 427135 - DNA, 36 bp, Artificial Sequence
  Description of Artificial Sequence: Synthetic oligonucleotide
ctcccattaggtgacaggtttttagagaagccaatc

SEQ ID NO: 427136 - DNA, 37 bp, Artificial Sequence
  Description of Artificial Sequence: Synthetic oligonucleotide
tcccattaggtgacaggtttttagagaagccaatcag

SEQ ID NO: 427137 - DNA, 36 bp, Artificial Sequence
  Description of Artificial Sequence: Synthetic oligonucleotide
cccattaggtgacaggtttttagagaagccaatcag

SEQ ID NO: 427138 - DNA, 36 bp, Artificial Sequence
  Description of Artificial Sequence: Synthetic oligonucleotide
ccattaggtgacaggtttttagagaagccaatcagc

SEQ ID NO: 427139 - DNA, 36 bp, Artificial Sequence
  Description of Artificial Sequence: Synthetic oligonucleotide
cattaggtgacaggtttttagagaagccaatcagcg

SEQ ID NO: 427140 - DNA, 37 bp, Artificial Sequence
  Description of Artificial Sequence: Synthetic oligonucleotide
attaggtgacaggtttttagagaagccaatcagcgtc

SEQ ID NO: 427141 - DNA, 36 bp, Artificial Sequence
  Description of Artificial Sequence: Synthetic oligonucleotide
ttaggtgacaggtttttagagaagccaatcagcgtc

SEQ ID NO: 427142 - DNA, 35 bp, Artificial Sequence
  Description of Artificial Sequence: Synthetic oligonucleotide
taggtgacaggtttttagagaagccaatcagcgtc

SEQ ID NO: 427143 - DNA, 34 bp, Artificial Sequence
  Description of Artificial Sequence: Synthetic oligonucleotide
aggtgacaggtttttagagaagccaatcagcgtc

SEQ ID NO: 427144 - DNA, 33 bp, Artificial Sequence
  Description of Artificial Sequence: Synthetic oligonucleotide
ggtgacaggtttttagagaagccaatcagcgtc

SEQ ID NO: 427145 - DNA, 33 bp, Artificial Sequence
  Description of Artificial Sequence: Synthetic oligonucleotide
gtgacaggtttttagagaagccaatcagcgtcg

SEQ ID NO: 427146 - DNA, 33 bp, Artificial Sequence
  Description of Artificial Sequence: Synthetic oligonucleotide
tgacaggtttttagagaagccaatcagcgtcgc

SEQ ID NO: 427147 - DNA, 32 bp, Artificial Sequence
  Description of Artificial Sequence: Synthetic oligonucleotide
gacaggtttttagagaagccaatcagcgtcgc

SEQ ID NO: 427148 - DNA, 32 bp, Artificial Sequence
  Description of Artificial Sequence: Synthetic oligonucleotide
acaggtttttagagaagccaatcagcgtcgcc

SEQ ID NO: 427149 - DNA, 31 bp, Artificial Sequence
  Description of Artificial Sequence: Synthetic oligonucleotide
caggtttttagagaagccaatcagcgtcgcc

SEQ ID NO: 427150 - DNA, 31 bp, Artificial Sequence
  Description of Artificial Sequence: Synthetic oligonucleotide
aggtttttagagaagccaatcagcgtcgccg

SEQ ID NO: 427151 - DNA, 30 bp, Artificial Sequence
  Description of Artificial Sequence: Synthetic oligonucleotide
ggtttttagagaagccaatcagcgtcgccg

SEQ ID NO: 427152 - DNA, 30 bp, Artificial Sequence
  Description of Artificial Sequence: Synthetic oligonucleotide
gtttttagagaagccaatcagcgtcgccgc

SEQ ID NO: 427153 - DNA, 30 bp, Artificial Sequence
  Description of Artificial Sequence: Synthetic oligonucleotide
tttttagagaagccaatcagcgtcgccgcg

SEQ ID NO: 427154 - DNA, 29 bp, Artificial Sequence
  Description of Artificial Sequence: Synthetic oligonucleotide
ttttagagaagccaatcagcgtcgccgcg

SEQ ID NO: 427155 - DNA, 28 bp, Artificial Sequence
  Description of Artificial Sequence: Synthetic oligonucleotide
tttagagaagccaatcagcgtcgccgcg

SEQ ID NO: 427156 - DNA, 27 bp, Artificial Sequence
  Description of Artificial Sequence: Synthetic oligonucleotide
ttagagaagccaatcagcgtcgccgcg

SEQ ID NO: 427157 - DNA, 23 bp, Artificial Sequence
  Description of Artificial Sequence: Synthetic oligonucleotide
ccaatcagcgtcgccgcggtcct

SEQ ID NO: 427158 - DNA, 23 bp, Artificial Sequence
  Description of Artificial Sequence: Synthetic oligonucleotide
caatcagcgtcgccgcggtcctg

SEQ ID NO: 427159 - DNA, 25 bp, Artificial Sequence
  Description of Artificial Sequence: Synthetic oligonucleotide
aatcagcgtcgccgcggtcctggtt

SEQ ID NO: 427160 - DNA, 24 bp, Artificial Sequence
  Description of Artificial Sequence: Synthetic oligonucleotide
atcagcgtcgccgcggtcctggtt

SEQ ID NO: 427161 - DNA, 23 bp, Artificial Sequence
  Description of Artificial Sequence: Synthetic oligonucleotide
tcagcgtcgccgcggtcctggtt

SEQ ID NO: 427162 - DNA, 22 bp, Artificial Sequence
  Description of Artificial Sequence: Synthetic oligonucleotide
cagcgtcgccgcggtcctggtt

SEQ ID NO: 427163 - DNA, 26 bp, Artificial Sequence
  Description of Artificial Sequence: Synthetic oligonucleotide
agcgtcgccgcggtcctggttctaaa

SEQ ID NO: 427164 - DNA, 25 bp, Artificial Sequence
  Description of Artificial Sequence: Synthetic oligonucleotide
gcgtcgccgcggtcctggttctaaa

SEQ ID NO: 427165 - DNA, 26 bp, Artificial Sequence
  Description of Artificial Sequence: Synthetic oligonucleotide
cgtcgccgcggtcctggttctaaagt

SEQ ID NO: 427166 - DNA, 26 bp, Artificial Sequence
  Description of Artificial Sequence: Synthetic oligonucleotide
gtcgccgcggtcctggttctaaagtc

SEQ ID NO: 427167 - DNA, 27 bp, Artificial Sequence
  Description of Artificial Sequence: Synthetic oligonucleotide
tcgccgcggtcctggttctaaagtcct

SEQ ID NO: 427168 - DNA, 26 bp, Artificial Sequence
  Description of Artificial Sequence: Synthetic oligonucleotide
cgccgcggtcctggttctaaagtcct

SEQ ID NO: 427169 - DNA, 26 bp, Artificial Sequence
  Description of Artificial Sequence: Synthetic oligonucleotide
gccgcggtcctggttctaaagtcctc

SEQ ID NO: 427170 - DNA, 26 bp, Artificial Sequence
  Description of Artificial Sequence: Synthetic oligonucleotide
ccgcggtcctggttctaaagtcctcg

SEQ ID NO: 427171 - DNA, 27 bp, Artificial Sequence
  Description of Artificial Sequence: Synthetic oligonucleotide
cgcggtcctggttctaaagtcctcgct

SEQ ID NO: 427172 - DNA, 27 bp, Artificial Sequence
  Description of Artificial Sequence: Synthetic oligonucleotide
gcggtcctggttctaaagtcctcgctc

SEQ ID NO: 427173 - DNA, 28 bp, Artificial Sequence
  Description of Artificial Sequence: Synthetic oligonucleotide
cggtcctggttctaaagtcctcgctcac

SEQ ID NO: 427174 - DNA, 28 bp, Artificial Sequence
  Description of Artificial Sequence: Synthetic oligonucleotide
ggtcctggttctaaagtcctcgctcacc

SEQ ID NO: 427175 - DNA, 28 bp, Artificial Sequence
  Description of Artificial Sequence: Synthetic oligonucleotide
gtcctggttctaaagtcctcgctcaccc

SEQ ID NO: 427176 - DNA, 29 bp, Artificial Sequence
  Description of Artificial Sequence: Synthetic oligonucleotide
tcctggttctaaagtcctcgctcacccac

SEQ ID NO: 427177 - DNA, 28 bp, Artificial Sequence
  Description of Artificial Sequence: Synthetic oligonucleotide
cctggttctaaagtcctcgctcacccac

SEQ ID NO: 427178 - DNA, 28 bp, Artificial Sequence
  Description of Artificial Sequence: Synthetic oligonucleotide
ctggttctaaagtcctcgctcacccacc

SEQ ID NO: 427179 - DNA, 28 bp, Artificial Sequence
  Description of Artificial Sequence: Synthetic oligonucleotide
tggttctaaagtcctcgctcacccaccc

SEQ ID NO: 427180 - DNA, 27 bp, Artificial Sequence
  Description of Artificial Sequence: Synthetic oligonucleotide
ggttctaaagtcctcgctcacccaccc

SEQ ID NO: 427181 - DNA, 27 bp, Artificial Sequence
  Description of Artificial Sequence: Synthetic oligonucleotide
gttctaaagtcctcgctcacccacccg

SEQ ID NO: 427182 - DNA, 27 bp, Artificial Sequence
  Description of Artificial Sequence: Synthetic oligonucleotide
ttctaaagtcctcgctcacccacccgg

SEQ ID NO: 427183 - DNA, 27 bp, Artificial Sequence
  Description of Artificial Sequence: Synthetic oligonucleotide
tctaaagtcctcgctcacccacccgga

SEQ ID NO: 427184 - DNA, 26 bp, Artificial Sequence
  Description of Artificial Sequence: Synthetic oligonucleotide
ctaaagtcctcgctcacccacccgga

SEQ ID NO: 427185 - DNA, 27 bp, Artificial Sequence
  Description of Artificial Sequence: Synthetic oligonucleotide
taaagtcctcgctcacccacccggact

SEQ ID NO: 427186 - DNA, 26 bp, Artificial Sequence
  Description of Artificial Sequence: Synthetic oligonucleotide
aaagtcctcgctcacccacccggact

SEQ ID NO: 427187 - DNA, 25 bp, Artificial Sequence
  Description of Artificial Sequence: Synthetic oligonucleotide
aagtcctcgctcacccacccggact

SEQ ID NO: 427188 - DNA, 24 bp, Artificial Sequence
  Description of Artificial Sequence: Synthetic oligonucleotide
agtcctcgctcacccacccggact

SEQ ID NO: 427189 - DNA, 23 bp, Artificial Sequence
  Description of Artificial Sequence: Synthetic oligonucleotide
gtcctcgctcacccacccggact

SEQ ID NO: 427190 - DNA, 26 bp, Artificial Sequence
  Description of Artificial Sequence: Synthetic oligonucleotide
tcctcgctcacccacccggactcatt

SEQ ID NO: 427191 - DNA, 25 bp, Artificial Sequence
  Description of Artificial Sequence: Synthetic oligonucleotide
cctcgctcacccacccggactcatt

SEQ ID NO: 427192 - DNA, 26 bp, Artificial Sequence
  Description of Artificial Sequence: Synthetic oligonucleotide
ctcgctcacccacccggactcattct

SEQ ID NO: 427193 - DNA, 26 bp, Artificial Sequence
  Description of Artificial Sequence: Synthetic oligonucleotide
tcgctcacccacccggactcattctc

SEQ ID NO: 427194 - DNA, 25 bp, Artificial Sequence
  Description of Artificial Sequence: Synthetic oligonucleotide
cgctcacccacccggactcattctc

SEQ ID NO: 427195 - DNA, 25 bp, Artificial Sequence
  Description of Artificial Sequence: Synthetic oligonucleotide
gctcacccacccggactcattctcc

SEQ ID NO: 427196 - DNA, 25 bp, Artificial Sequence
  Description of Artificial Sequence: Synthetic oligonucleotide
ctcacccacccggactcattctccc

SEQ ID NO: 427197 - DNA, 26 bp, Artificial Sequence
  Description of Artificial Sequence: Synthetic oligonucleotide
tcacccacccggactcattctcccca

SEQ ID NO: 427198 - DNA, 25 bp, Artificial Sequence
  Description of Artificial Sequence: Synthetic oligonucleotide
cacccacccggactcattctcccca

SEQ ID NO: 427199 - DNA, 26 bp, Artificial Sequence
  Description of Artificial Sequence: Synthetic oligonucleotide
acccacccggactcattctccccaga

SEQ ID NO: 427200 - DNA, 25 bp, Artificial Sequence
  Description of Artificial Sequence: Synthetic oligonucleotide
cccacccggactcattctccccaga

SEQ ID NO: 427201 - DNA, 25 bp, Artificial Sequence
  Description of Artificial Sequence: Synthetic oligonucleotide
ccacccggactcattctccccagac

SEQ ID NO: 427202 - DNA, 25 bp, Artificial Sequence
  Description of Artificial Sequence: Synthetic oligonucleotide
cacccggactcattctccccagacg

SEQ ID NO: 427203 - DNA, 25 bp, Artificial Sequence
  Description of Artificial Sequence: Synthetic oligonucleotide
acccggactcattctccccagacgc

SEQ ID NO: 427204 - DNA, 24 bp, Artificial Sequence
  Description of Artificial Sequence: Synthetic oligonucleotide
cccggactcattctccccagacgc

SEQ ID NO: 427205 - DNA, 26 bp, Artificial Sequence
  Description of Artificial Sequence: Synthetic oligonucleotide
ccggactcattctccccagacgccaa

SEQ ID NO: 427206 - DNA, 26 bp, Artificial Sequence
  Description of Artificial Sequence: Synthetic oligonucleotide
cggactcattctccccagacgccaag

SEQ ID NO: 427207 - DNA, 27 bp, Artificial Sequence
  Description of Artificial Sequence: Synthetic oligonucleotide
ggactcattctccccagacgccaagga

SEQ ID NO: 427208 - DNA, 28 bp, Artificial Sequence
  Description of Artificial Sequence: Synthetic oligonucleotide
gactcattctccccagacgccaaggatg

SEQ ID NO: 427209 - DNA, 28 bp, Artificial Sequence
  Description of Artificial Sequence: Synthetic oligonucleotide
actcattctccccagacgccaaggatgg

SEQ ID NO: 427210 - DNA, 27 bp, Artificial Sequence
  Description of Artificial Sequence: Synthetic oligonucleotide
ctcattctccccagacgccaaggatgg

SEQ ID NO: 427211 - DNA, 28 bp, Artificial Sequence
  Description of Artificial Sequence: Synthetic oligonucleotide
tcattctccccagacgccaaggatggtg

SEQ ID NO: 427212 - DNA, 27 bp, Artificial Sequence
  Description of Artificial Sequence: Synthetic oligonucleotide
cattctccccagacgccaaggatggtg

SEQ ID NO: 427213 - DNA, 27 bp, Artificial Sequence
  Description of Artificial Sequence: Synthetic oligonucleotide
attctccccagacgccaaggatggtgg

SEQ ID NO: 427214 - DNA, 27 bp, Artificial Sequence
  Description of Artificial Sequence: Synthetic oligonucleotide
ttctccccagacgccaaggatggtggt

SEQ ID NO: 427215 - DNA, 26 bp, Artificial Sequence
  Description of Artificial Sequence: Synthetic oligonucleotide
tctccccagacgccaaggatggtggt

SEQ ID NO: 427216 - DNA, 25 bp, Artificial Sequence
  Description of Artificial Sequence: Synthetic oligonucleotide
ctccccagacgccaaggatggtggt

SEQ ID NO: 427217 - DNA, 27 bp, Artificial Sequence
  Description of Artificial Sequence: Synthetic oligonucleotide
tccccagacgccaaggatggtggtcat

SEQ ID NO: 427218 - DNA, 26 bp, Artificial Sequence
  Description of Artificial Sequence: Synthetic oligonucleotide
ccccagacgccaaggatggtggtcat

SEQ ID NO: 427219 - DNA, 26 bp, Artificial Sequence
  Description of Artificial Sequence: Synthetic oligonucleotide
cccagacgccaaggatggtggtcatg

SEQ ID NO: 427220 - DNA, 26 bp, Artificial Sequence
  Description of Artificial Sequence: Synthetic oligonucleotide
ccagacgccaaggatggtggtcatgg

SEQ ID NO: 427221 - DNA, 26 bp, Artificial Sequence
  Description of Artificial Sequence: Synthetic oligonucleotide
cagacgccaaggatggtggtcatggc

SEQ ID NO: 427222 - DNA, 26 bp, Artificial Sequence
  Description of Artificial Sequence: Synthetic oligonucleotide
agacgccaaggatggtggtcatggcg

SEQ ID NO: 427223 - DNA, 25 bp, Artificial Sequence
  Description of Artificial Sequence: Synthetic oligonucleotide
gacgccaaggatggtggtcatggcg

SEQ ID NO: 427224 - DNA, 25 bp, Artificial Sequence
  Description of Artificial Sequence: Synthetic oligonucleotide
acgccaaggatggtggtcatggcgc

SEQ ID NO: 427225 - DNA, 24 bp, Artificial Sequence
  Description of Artificial Sequence: Synthetic oligonucleotide
cgccaaggatggtggtcatggcgc

SEQ ID NO: 427226 - DNA, 24 bp, Artificial Sequence
  Description of Artificial Sequence: Synthetic oligonucleotide
gccaaggatggtggtcatggcgcc

SEQ ID NO: 427227 - DNA, 24 bp, Artificial Sequence
  Description of Artificial Sequence: Synthetic oligonucleotide
ccaaggatggtggtcatggcgccc

SEQ ID NO: 427228 - DNA, 24 bp, Artificial Sequence
  Description of Artificial Sequence: Synthetic oligonucleotide
caaggatggtggtcatggcgcccc

SEQ ID NO: 427229 - DNA, 26 bp, Artificial Sequence
  Description of Artificial Sequence: Synthetic oligonucleotide
aaggatggtggtcatggcgccccgaa

SEQ ID NO: 427230 - DNA, 25 bp, Artificial Sequence
  Description of Artificial Sequence: Synthetic oligonucleotide
aggatggtggtcatggcgccccgaa

SEQ ID NO: 427231 - DNA, 24 bp, Artificial Sequence
  Description of Artificial Sequence: Synthetic oligonucleotide
ggatggtggtcatggcgccccgaa

SEQ ID NO: 427232 - DNA, 24 bp, Artificial Sequence
  Description of Artificial Sequence: Synthetic oligonucleotide
gatggtggtcatggcgccccgaac

SEQ ID NO: 427233 - DNA, 24 bp, Artificial Sequence
  Description of Artificial Sequence: Synthetic oligonucleotide
atggtggtcatggcgccccgaacc

SEQ ID NO: 427234 - DNA, 23 bp, Artificial Sequence
  Description of Artificial Sequence: Synthetic oligonucleotide
tggtggtcatggcgccccgaacc

SEQ ID NO: 427235 - DNA, 22 bp, Artificial Sequence
  Description of Artificial Sequence: Synthetic oligonucleotide
ggtggtcatggcgccccgaacc

SEQ ID NO: 427236 - DNA, 23 bp, Artificial Sequence
  Description of Artificial Sequence: Synthetic oligonucleotide
gtggtcatggcgccccgaaccct

SEQ ID NO: 427237 - DNA, 25 bp, Artificial Sequence
  Description of Artificial Sequence: Synthetic oligonucleotide
tggtcatggcgccccgaaccctctt

SEQ ID NO: 427238 - DNA, 24 bp, Artificial Sequence
  Description of Artificial Sequence: Synthetic oligonucleotide
ggtcatggcgccccgaaccctctt

SEQ ID NO: 427239 - DNA, 24 bp, Artificial Sequence
  Description of Artificial Sequence: Synthetic oligonucleotide
gtcatggcgccccgaaccctcttc

SEQ ID NO: 427240 - DNA, 25 bp, Artificial Sequence
  Description of Artificial Sequence: Synthetic oligonucleotide
tcatggcgccccgaaccctcttcct

SEQ ID NO: 427241 - DNA, 24 bp, Artificial Sequence
  Description of Artificial Sequence: Synthetic oligonucleotide
catggcgccccgaaccctcttcct

SEQ ID NO: 427242 - DNA, 24 bp, Artificial Sequence
  Description of Artificial Sequence: Synthetic oligonucleotide
atggcgccccgaaccctcttcctg

SEQ ID NO: 427243 - DNA, 23 bp, Artificial Sequence
  Description of Artificial Sequence: Synthetic oligonucleotide
tggcgccccgaaccctcttcctg

SEQ ID NO: 427244 - DNA, 22 bp, Artificial Sequence
  Description of Artificial Sequence: Synthetic oligonucleotide
ggcgccccgaaccctcttcctg

SEQ ID NO: 427245 - DNA, 23 bp, Artificial Sequence
  Description of Artificial Sequence: Synthetic oligonucleotide
gcgccccgaaccctcttcctgct

SEQ ID NO: 427246 - DNA, 23 bp, Artificial Sequence
  Description of Artificial Sequence: Synthetic oligonucleotide
cgccccgaaccctcttcctgctg

SEQ ID NO: 427247 - DNA, 24 bp, Artificial Sequence
  Description of Artificial Sequence: Synthetic oligonucleotide
gccccgaaccctcttcctgctgct

SEQ ID NO: 427248 - DNA, 25 bp, Artificial Sequence
  Description of Artificial Sequence: Synthetic oligonucleotide
ccccgaaccctcttcctgctgctct

SEQ ID NO: 427249 - DNA, 25 bp, Artificial Sequence
  Description of Artificial Sequence: Synthetic oligonucleotide
cccgaaccctcttcctgctgctctc

SEQ ID NO: 427250 - DNA, 25 bp, Artificial Sequence
  Description of Artificial Sequence: Synthetic oligonucleotide
ccgaaccctcttcctgctgctctcg

SEQ ID NO: 427251 - DNA, 25 bp, Artificial Sequence
  Description of Artificial Sequence: Synthetic oligonucleotide
cgaaccctcttcctgctgctctcgg

SEQ ID NO: 427252 - DNA, 25 bp, Artificial Sequence
  Description of Artificial Sequence: Synthetic oligonucleotide
gaaccctcttcctgctgctctcggg

SEQ ID NO: 427253 - DNA, 25 bp, Artificial Sequence
  Description of Artificial Sequence: Synthetic oligonucleotide
aaccctcttcctgctgctctcgggg

SEQ ID NO: 427254 - DNA, 24 bp, Artificial Sequence
  Description of Artificial Sequence: Synthetic oligonucleotide
accctcttcctgctgctctcgggg

SEQ ID NO: 427255 - DNA, 23 bp, Artificial Sequence
  Description of Artificial Sequence: Synthetic oligonucleotide
ccctcttcctgctgctctcgggg

SEQ ID NO: 427256 - DNA, 23 bp, Artificial Sequence
  Description of Artificial Sequence: Synthetic oligonucleotide
cctcttcctgctgctctcggggg

SEQ ID NO: 427257 - DNA, 23 bp, Artificial Sequence
  Description of Artificial Sequence: Synthetic oligonucleotide
ctcttcctgctgctctcgggggc

SEQ ID NO: 427258 - DNA, 23 bp, Artificial Sequence
  Description of Artificial Sequence: Synthetic oligonucleotide
tcttcctgctgctctcgggggcc

SEQ ID NO: 427259 - DNA, 22 bp, Artificial Sequence
  Description of Artificial Sequence: Synthetic oligonucleotide
cttcctgctgctctcgggggcc

SEQ ID NO: 427260 - DNA, 23 bp, Artificial Sequence
  Description of Artificial Sequence: Synthetic oligonucleotide
ttcctgctgctctcgggggccct

SEQ ID NO: 427261 - DNA, 22 bp, Artificial Sequence
  Description of Artificial Sequence: Synthetic oligonucleotide
tcctgctgctctcgggggccct

SEQ ID NO: 427262 - DNA, 21 bp, Artificial Sequence
  Description of Artificial Sequence: Synthetic oligonucleotide
cctgctgctctcgggggccct

SEQ ID NO: 427263 - DNA, 22 bp, Artificial Sequence
  Description of Artificial Sequence: Synthetic oligonucleotide
ctgctgctctcgggggccctga

SEQ ID NO: 427264 - DNA, 22 bp, Artificial Sequence
  Description of Artificial Sequence: Synthetic oligonucleotide
tgctgctctcgggggccctgac

SEQ ID NO: 427265 - DNA, 21 bp, Artificial Sequence
  Description of Artificial Sequence: Synthetic oligonucleotide
gctgctctcgggggccctgac

SEQ ID NO: 427266 - DNA, 21 bp, Artificial Sequence
  Description of Artificial Sequence: Synthetic oligonucleotide
ctgctctcgggggccctgacc

SEQ ID NO: 427267 - DNA, 22 bp, Artificial Sequence
  Description of Artificial Sequence: Synthetic oligonucleotide
tgctctcgggggccctgaccct

SEQ ID NO: 427268 - DNA, 21 bp, Artificial Sequence
  Description of Artificial Sequence: Synthetic oligonucleotide
gctctcgggggccctgaccct

SEQ ID NO: 427269 - DNA, 22 bp, Artificial Sequence
  Description of Artificial Sequence: Synthetic oligonucleotide
ctctcgggggccctgaccctga

SEQ ID NO: 427270 - DNA, 22 bp, Artificial Sequence
  Description of Artificial Sequence: Synthetic oligonucleotide
tctcgggggccctgaccctgac

SEQ ID NO: 427271 - DNA, 21 bp, Artificial Sequence
  Description of Artificial Sequence: Synthetic oligonucleotide
ctcgggggccctgaccctgac

SEQ ID NO: 427272 - DNA, 21 bp, Artificial Sequence
  Description of Artificial Sequence: Synthetic oligonucleotide
tcgggggccctgaccctgacc

SEQ ID NO: 427273 - DNA, 20 bp, Artificial Sequence
  Description of Artificial Sequence: Synthetic oligonucleotide
cgggggccctgaccctgacc

SEQ ID NO: 427274 - DNA, 21 bp, Artificial Sequence
  Description of Artificial Sequence: Synthetic oligonucleotide
gggggccctgaccctgaccga

SEQ ID NO: 427275 - DNA, 22 bp, Artificial Sequence
  Description of Artificial Sequence: Synthetic oligonucleotide
ggggccctgaccctgaccgaga

SEQ ID NO: 427276 - DNA, 22 bp, Artificial Sequence
  Description of Artificial Sequence: Synthetic oligonucleotide
gggccctgaccctgaccgagac

SEQ ID NO: 427277 - DNA, 23 bp, Artificial Sequence
  Description of Artificial Sequence: Synthetic oligonucleotide
ggccctgaccctgaccgagacct

SEQ ID NO: 427278 - DNA, 23 bp, Artificial Sequence
  Description of Artificial Sequence: Synthetic oligonucleotide
gccctgaccctgaccgagacctg

SEQ ID NO: 427279 - DNA, 23 bp, Artificial Sequence
  Description of Artificial Sequence: Synthetic oligonucleotide
ccctgaccctgaccgagacctgg

SEQ ID NO: 427280 - DNA, 23 bp, Artificial Sequence
  Description of Artificial Sequence: Synthetic oligonucleotide
cctgaccctgaccgagacctggg

SEQ ID NO: 427281 - DNA, 23 bp, Artificial Sequence
  Description of Artificial Sequence: Synthetic oligonucleotide
ctgaccctgaccgagacctgggc

SEQ ID NO: 427282 - DNA, 23 bp, Artificial Sequence
  Description of Artificial Sequence: Synthetic oligonucleotide
tgaccctgaccgagacctgggcg

SEQ ID NO: 427283 - DNA, 22 bp, Artificial Sequence
  Description of Artificial Sequence: Synthetic oligonucleotide
gaccctgaccgagacctgggcg

SEQ ID NO: 427284 - DNA, 22 bp, Artificial Sequence
  Description of Artificial Sequence: Synthetic oligonucleotide
accctgaccgagacctgggcgg

SEQ ID NO: 427285 - DNA, 28 bp, Artificial Sequence
  Description of Artificial Sequence: Synthetic oligonucleotide
cgggctcccactccatgaggtatttcag

SEQ ID NO: 427286 - DNA, 28 bp, Artificial Sequence
  Description of Artificial Sequence: Synthetic oligonucleotide
gggctcccactccatgaggtatttcagc

SEQ ID NO: 427287 - DNA, 28 bp, Artificial Sequence
  Description of Artificial Sequence: Synthetic oligonucleotide
ggctcccactccatgaggtatttcagcg

SEQ ID NO: 427288 - DNA, 28 bp, Artificial Sequence
  Description of Artificial Sequence: Synthetic oligonucleotide
gctcccactccatgaggtatttcagcgc

SEQ ID NO: 427289 - DNA, 28 bp, Artificial Sequence
  Description of Artificial Sequence: Synthetic oligonucleotide
ctcccactccatgaggtatttcagcgcc

SEQ ID NO: 427290 - DNA, 28 bp, Artificial Sequence
  Description of Artificial Sequence: Synthetic oligonucleotide
tcccactccatgaggtatttcagcgccg

SEQ ID NO: 427291 - DNA, 27 bp, Artificial Sequence
  Description of Artificial Sequence: Synthetic oligonucleotide
cccactccatgaggtatttcagcgccg

SEQ ID NO: 427292 - DNA, 27 bp, Artificial Sequence
  Description of Artificial Sequence: Synthetic oligonucleotide
ccactccatgaggtatttcagcgccgc

SEQ ID NO: 427293 - DNA, 27 bp, Artificial Sequence
  Description of Artificial Sequence: Synthetic oligonucleotide
cactccatgaggtatttcagcgccgcc

SEQ ID NO: 427294 - DNA, 27 bp, Artificial Sequence
  Description of Artificial Sequence: Synthetic oligonucleotide
actccatgaggtatttcagcgccgccg

SEQ ID NO: 427295 - DNA, 27 bp, Artificial Sequence
  Description of Artificial Sequence: Synthetic oligonucleotide
ctccatgaggtatttcagcgccgccgt

SEQ ID NO: 427296 - DNA, 27 bp, Artificial Sequence
  Description of Artificial Sequence: Synthetic oligonucleotide
tccatgaggtatttcagcgccgccgtg

SEQ ID NO: 427297 - DNA, 27 bp, Artificial Sequence
  Description of Artificial Sequence: Synthetic oligonucleotide
ccatgaggtatttcagcgccgccgtgt

SEQ ID NO: 427298 - DNA, 27 bp, Artificial Sequence
  Description of Artificial Sequence: Synthetic oligonucleotide
catgaggtatttcagcgccgccgtgtc

SEQ ID NO: 427299 - DNA, 27 bp, Artificial Sequence
  Description of Artificial Sequence: Synthetic oligonucleotide
atgaggtatttcagcgccgccgtgtcc

SEQ ID NO: 427300 - DNA, 26 bp, Artificial Sequence
  Description of Artificial Sequence: Synthetic oligonucleotide
tgaggtatttcagcgccgccgtgtcc

SEQ ID NO: 427301 - DNA, 25 bp, Artificial Sequence
  Description of Artificial Sequence: Synthetic oligonucleotide
gaggtatttcagcgccgccgtgtcc

SEQ ID NO: 427302 - DNA, 25 bp, Artificial Sequence
  Description of Artificial Sequence: Synthetic oligonucleotide
aggtatttcagcgccgccgtgtccc

SEQ ID NO: 427303 - DNA, 24 bp, Artificial Sequence
  Description of Artificial Sequence: Synthetic oligonucleotide
ggtatttcagcgccgccgtgtccc

SEQ ID NO: 427304 - DNA, 24 bp, Artificial Sequence
  Description of Artificial Sequence: Synthetic oligonucleotide
gtatttcagcgccgccgtgtcccg

SEQ ID NO: 427305 - DNA, 24 bp, Artificial Sequence
  Description of Artificial Sequence: Synthetic oligonucleotide
tatttcagcgccgccgtgtcccgg

SEQ ID NO: 427306 - DNA, 23 bp, Artificial Sequence
  Description of Artificial Sequence: Synthetic oligonucleotide
atttcagcgccgccgtgtcccgg

SEQ ID NO: 427307 - DNA, 22 bp, Artificial Sequence
  Description of Artificial Sequence: Synthetic oligonucleotide
tttcagcgccgccgtgtcccgg

SEQ ID NO: 427308 - DNA, 21 bp, Artificial Sequence
  Description of Artificial Sequence: Synthetic oligonucleotide
ttcagcgccgccgtgtcccgg

SEQ ID NO: 427309 - DNA, 20 bp, Artificial Sequence
  Description of Artificial Sequence: Synthetic oligonucleotide
tcagcgccgccgtgtcccgg

SEQ ID NO: 427310 - DNA, 20 bp, Artificial Sequence
  Description of Artificial Sequence: Synthetic oligonucleotide
cagcgccgccgtgtcccggt

SEQ ID NO: 427311 - DNA, 20 bp, Artificial Sequence
  Description of Artificial Sequence: Synthetic oligonucleotide
agcgccgccgtgtcccggct

SEQ ID NO: 427312 - DNA, 20 bp, Artificial Sequence
  Description of Artificial Sequence: Synthetic oligonucleotide
gcgccgccgtgtcccggctt

SEQ ID NO: 427313 - DNA, 20 bp, Artificial Sequence
  Description of Artificial Sequence: Synthetic oligonucleotide
cgccgccgtgtcccggcctt

SEQ ID NO: 427314 - DNA, 20 bp, Artificial Sequence
  Description of Artificial Sequence: Synthetic oligonucleotide
gccgccgtgtcccggccctt

SEQ ID NO: 427315 - DNA, 23 bp, Artificial Sequence
  Description of Artificial Sequence: Synthetic oligonucleotide
ggggagccccgcttcatcgccat

SEQ ID NO: 427316 - DNA, 23 bp, Artificial Sequence
  Description of Artificial Sequence: Synthetic oligonucleotide
gggagccccgcttcatcgccatg

SEQ ID NO: 427317 - DNA, 23 bp, Artificial Sequence
  Description of Artificial Sequence: Synthetic oligonucleotide
ggagccccgcttcatcgccatgg

SEQ ID NO: 427318 - DNA, 23 bp, Artificial Sequence
  Description of Artificial Sequence: Synthetic oligonucleotide
gagccccgcttcatcgccatggg

SEQ ID NO: 427319 - DNA, 25 bp, Artificial Sequence
  Description of Artificial Sequence: Synthetic oligonucleotide
agccccgcttcatcgccatgggcta

SEQ ID NO: 427320 - DNA, 24 bp, Artificial Sequence
  Description of Artificial Sequence: Synthetic oligonucleotide
gccccgcttcatcgccatgggcta

SEQ ID NO: 427321 - DNA, 24 bp, Artificial Sequence
  Description of Artificial Sequence: Synthetic oligonucleotide
ccccgcttcatcgccatgggctac

SEQ ID NO: 427322 - DNA, 25 bp, Artificial Sequence
  Description of Artificial Sequence: Synthetic oligonucleotide
cccgcttcatcgccatgggctacgt

SEQ ID NO: 427323 - DNA, 25 bp, Artificial Sequence
  Description of Artificial Sequence: Synthetic oligonucleotide
ccgcttcatcgccatgggctacgtg

SEQ ID NO: 427324 - DNA, 26 bp, Artificial Sequence
  Description of Artificial Sequence: Synthetic oligonucleotide
cgcttcatcgccatgggctacgtgga

SEQ ID NO: 427325 - DNA, 26 bp, Artificial Sequence
  Description of Artificial Sequence: Synthetic oligonucleotide
gcttcatcgccatgggctacgtggac

SEQ ID NO: 427326 - DNA, 27 bp, Artificial Sequence
  Description of Artificial Sequence: Synthetic oligonucleotide
cttcatcgccatgggctacgtggacga

SEQ ID NO: 427327 - DNA, 27 bp, Artificial Sequence
  Description of Artificial Sequence: Synthetic oligonucleotide
ttcatcgccatgggctacgtggacgac

SEQ ID NO: 427328 - DNA, 27 bp, Artificial Sequence
  Description of Artificial Sequence: Synthetic oligonucleotide
tcatcgccatgggctacgtggacgaca

SEQ ID NO: 427329 - DNA, 26 bp, Artificial Sequence
  Description of Artificial Sequence: Synthetic oligonucleotide
catcgccatgggctacgtggacgaca

SEQ ID NO: 427330 - DNA, 26 bp, Artificial Sequence
  Description of Artificial Sequence: Synthetic oligonucleotide
atcgccatgggctacgtggacgacac

SEQ ID NO: 427331 - DNA, 25 bp, Artificial Sequence
  Description of Artificial Sequence: Synthetic oligonucleotide
tcgccatgggctacgtggacgacac

SEQ ID NO: 427332 - DNA, 24 bp, Artificial Sequence
  Description of Artificial Sequence: Synthetic oligonucleotide
cgccatgggctacgtggacgacac

SEQ ID NO: 427333 - DNA, 24 bp, Artificial Sequence
  Description of Artificial Sequence: Synthetic oligonucleotide
gccatgggctacgtggacgacacg

SEQ ID NO: 427334 - DNA, 25 bp, Artificial Sequence
  Description of Artificial Sequence: Synthetic oligonucleotide
ccatgggctacgtggacgacacgca

SEQ ID NO: 427335 - DNA, 27 bp, Artificial Sequence
  Description of Artificial Sequence: Synthetic oligonucleotide
catgggctacgtggacgacacgcagtt

SEQ ID NO: 427336 - DNA, 27 bp, Artificial Sequence
  Description of Artificial Sequence: Synthetic oligonucleotide
atgggctacgtggacgacacgcagttc

SEQ ID NO: 427337 - DNA, 26 bp, Artificial Sequence
  Description of Artificial Sequence: Synthetic oligonucleotide
gcagttcgtgcggttcgacagcgact

SEQ ID NO: 427338 - DNA, 26 bp, Artificial Sequence
  Description of Artificial Sequence: Synthetic oligonucleotide
cagttcgtgcggttcgacagcgactc

SEQ ID NO: 427339 - DNA, 26 bp, Artificial Sequence
  Description of Artificial Sequence: Synthetic oligonucleotide
agttcgtgcggttcgacagcgactcg

SEQ ID NO: 427340 - DNA, 25 bp, Artificial Sequence
  Description of Artificial Sequence: Synthetic oligonucleotide
gttcgtgcggttcgacagcgactcg

SEQ ID NO: 427341 - DNA, 25 bp, Artificial Sequence
  Description of Artificial Sequence: Synthetic oligonucleotide
ttcgtgcggttcgacagcgactcgg

SEQ ID NO: 427342 - DNA, 24 bp, Artificial Sequence
  Description of Artificial Sequence: Synthetic oligonucleotide
tcgtgcggttcgacagcgactcgg

SEQ ID NO: 427343 - DNA, 23 bp, Artificial Sequence
  Description of Artificial Sequence: Synthetic oligonucleotide
cgtgcggttcgacagcgactcgg

SEQ ID NO: 427344 - DNA, 23 bp, Artificial Sequence
  Description of Artificial Sequence: Synthetic oligonucleotide
gtgcggttcgacagcgactcggc

SEQ ID NO: 427345 - DNA, 24 bp, Artificial Sequence
  Description of Artificial Sequence: Synthetic oligonucleotide
tgcggttcgacagcgactcggcgt

SEQ ID NO: 427346 - DNA, 23 bp, Artificial Sequence
  Description of Artificial Sequence: Synthetic oligonucleotide
gcggttcgacagcgactcggcgt

SEQ ID NO: 427347 - DNA, 24 bp, Artificial Sequence
  Description of Artificial Sequence: Synthetic oligonucleotide
cggttcgacagcgactcggcgtgt

SEQ ID NO: 427348 - DNA, 24 bp, Artificial Sequence
  Description of Artificial Sequence: Synthetic oligonucleotide
ggttcgacagcgactcggcgtgtc

SEQ ID NO: 427349 - DNA, 24 bp, Artificial Sequence
  Description of Artificial Sequence: Synthetic oligonucleotide
gttcgacagcgactcggcgtgtcc

SEQ ID NO: 427350 - DNA, 25 bp, Artificial Sequence
  Description of Artificial Sequence: Synthetic oligonucleotide
ttcgacagcgactcggcgtgtccga

SEQ ID NO: 427351 - DNA, 24 bp, Artificial Sequence
  Description of Artificial Sequence: Synthetic oligonucleotide
tcgacagcgactcggcgtgtccga

SEQ ID NO: 427352 - DNA, 23 bp, Artificial Sequence
  Description of Artificial Sequence: Synthetic oligonucleotide
cgacagcgactcggcgtgtccga

SEQ ID NO: 427353 - DNA, 23 bp, Artificial Sequence
  Description of Artificial Sequence: Synthetic oligonucleotide
gacagcgactcggcgtgtccgag

SEQ ID NO: 427354 - DNA, 25 bp, Artificial Sequence
  Description of Artificial Sequence: Synthetic oligonucleotide
acagcgactcggcgtgtccgaggat

SEQ ID NO: 427355 - DNA, 24 bp, Artificial Sequence
  Description of Artificial Sequence: Synthetic oligonucleotide
cagcgactcggcgtgtccgaggat

SEQ ID NO: 427356 - DNA, 24 bp, Artificial Sequence
  Description of Artificial Sequence: Synthetic oligonucleotide
agcgactcggcgtgtccgaggatg

SEQ ID NO: 427357 - DNA, 23 bp, Artificial Sequence
  Description of Artificial Sequence: Synthetic oligonucleotide
gcgactcggcgtgtccgaggatg

SEQ ID NO: 427358 - DNA, 24 bp, Artificial Sequence
  Description of Artificial Sequence: Synthetic oligonucleotide
cgactcggcgtgtccgaggatgga

SEQ ID NO: 427359 - DNA, 24 bp, Artificial Sequence
  Description of Artificial Sequence: Synthetic oligonucleotide
gactcggcgtgtccgaggatggag

SEQ ID NO: 427360 - DNA, 24 bp, Artificial Sequence
  Description of Artificial Sequence: Synthetic oligonucleotide
actcggcgtgtccgaggatggagc

SEQ ID NO: 427361 - DNA, 23 bp, Artificial Sequence
  Description of Artificial Sequence: Synthetic oligonucleotide
ctcggcgtgtccgaggatggagc

SEQ ID NO: 427362 - DNA, 23 bp, Artificial Sequence
  Description of Artificial Sequence: Synthetic oligonucleotide
tcggcgtgtccgaggatggagcc

SEQ ID NO: 427363 - DNA, 22 bp, Artificial Sequence
  Description of Artificial Sequence: Synthetic oligonucleotide
cggcgtgtccgaggatggagcc

SEQ ID NO: 427364 - DNA, 22 bp, Artificial Sequence
  Description of Artificial Sequence: Synthetic oligonucleotide
ggcgtgtccgaggatggagccg

SEQ ID NO: 427365 - DNA, 22 bp, Artificial Sequence
  Description of Artificial Sequence: Synthetic oligonucleotide
gcgtgtccgaggatggagccgc

SEQ ID NO: 427366 - DNA, 22 bp, Artificial Sequence
  Description of Artificial Sequence: Synthetic oligonucleotide
cgtgtccgaggatggagccgcg

SEQ ID NO: 427367 - DNA, 22 bp, Artificial Sequence
  Description of Artificial Sequence: Synthetic oligonucleotide
gtgtccgaggatggagccgcgg

SEQ ID NO: 427368 - DNA, 22 bp, Artificial Sequence
  Description of Artificial Sequence: Synthetic oligonucleotide
tgtccgaggatggagccgcggg

SEQ ID NO: 427369 - DNA, 21 bp, Artificial Sequence
  Description of Artificial Sequence: Synthetic oligonucleotide
gtccgaggatggagccgcggg

SEQ ID NO: 427370 - DNA, 21 bp, Artificial Sequence
  Description of Artificial Sequence: Synthetic oligonucleotide
tccgaggatggagccgcgggc

SEQ ID NO: 427371 - DNA, 20 bp, Artificial Sequence
  Description of Artificial Sequence: Synthetic oligonucleotide
ccgaggatggagccgcgggc

SEQ ID NO: 427372 - DNA, 20 bp, Artificial Sequence
  Description of Artificial Sequence: Synthetic oligonucleotide
cgaggatggagccgcgggcg

SEQ ID NO: 427373 - DNA, 26 bp, Artificial Sequence
  Description of Artificial Sequence: Synthetic oligonucleotide
agcaggaggggccggagtattgggaa

SEQ ID NO: 427374 - DNA, 25 bp, Artificial Sequence
  Description of Artificial Sequence: Synthetic oligonucleotide
gcaggaggggccggagtattgggaa

SEQ ID NO: 427375 - DNA, 26 bp, Artificial Sequence
  Description of Artificial Sequence: Synthetic oligonucleotide
caggaggggccggagtattgggaaga

SEQ ID NO: 427376 - DNA, 26 bp, Artificial Sequence
  Description of Artificial Sequence: Synthetic oligonucleotide
aggaggggccggagtattgggaagag

SEQ ID NO: 427377 - DNA, 25 bp, Artificial Sequence
  Description of Artificial Sequence: Synthetic oligonucleotide
ggaggggccggagtattgggaagag

SEQ ID NO: 427378 - DNA, 26 bp, Artificial Sequence
  Description of Artificial Sequence: Synthetic oligonucleotide
gaggggccggagtattgggaagagga

SEQ ID NO: 427379 - DNA, 27 bp, Artificial Sequence
  Description of Artificial Sequence: Synthetic oligonucleotide
aggggccggagtattgggaagaggaga

SEQ ID NO: 427380 - DNA, 26 bp, Artificial Sequence
  Description of Artificial Sequence: Synthetic oligonucleotide
ggggccggagtattgggaagaggaga

SEQ ID NO: 427381 - DNA, 27 bp, Artificial Sequence
  Description of Artificial Sequence: Synthetic oligonucleotide
gggccggagtattgggaagaggagaca

SEQ ID NO: 427382 - DNA, 27 bp, Artificial Sequence
  Description of Artificial Sequence: Synthetic oligonucleotide
ggccggagtattgggaagaggagacac

SEQ ID NO: 427383 - DNA, 27 bp, Artificial Sequence
  Description of Artificial Sequence: Synthetic oligonucleotide
gccggagtattgggaagaggagacacg

SEQ ID NO: 427384 - DNA, 27 bp, Artificial Sequence
  Description of Artificial Sequence: Synthetic oligonucleotide
ccggagtattgggaagaggagacacgg

SEQ ID NO: 427385 - DNA, 29 bp, Artificial Sequence
  Description of Artificial Sequence: Synthetic oligonucleotide
cggagtattgggaagaggagacacggaac

SEQ ID NO: 427386 - DNA, 30 bp, Artificial Sequence; identical to SEQ ID NO: 77505
  Description of Artificial Sequence: Synthetic oligonucleotide

SEQ ID NO: 427387 - DNA, 30 bp, Artificial Sequence; identical to SEQ ID NO: 77506
  Description of Artificial Sequence: Synthetic oligonucleotide

SEQ ID NO: 427388 - DNA, 32 bp, Artificial Sequence; identical to SEQ ID NO: 77507
  Description of Artificial Sequence: Synthetic oligonucleotide

SEQ ID NO: 427389 - DNA, 31 bp, Artificial Sequence; identical to SEQ ID NO: 77508
  Description of Artificial Sequence: Synthetic oligonucleotide

SEQ ID NO: 427390 - DNA, 31 bp, Artificial Sequence; identical to SEQ ID NO: 77509
  Description of Artificial Sequence: Synthetic oligonucleotide

SEQ ID NO: 427391 - DNA, 30 bp, Artificial Sequence; identical to SEQ ID NO: 77510
  Description of Artificial Sequence: Synthetic oligonucleotide

SEQ ID NO: 427392 - DNA, 29 bp, Artificial Sequence
  Description of Artificial Sequence: Synthetic oligonucleotide
ttgggaagaggagacacggaacaccaagg

SEQ ID NO: 427393 - DNA, 28 bp, Artificial Sequence
  Description of Artificial Sequence: Synthetic oligonucleotide
tgggaagaggagacacggaacaccaagg

SEQ ID NO: 427394 - DNA, 27 bp, Artificial Sequence
  Description of Artificial Sequence: Synthetic oligonucleotide
gggaagaggagacacggaacaccaagg

SEQ ID NO: 427395 - DNA, 27 bp, Artificial Sequence
  Description of Artificial Sequence: Synthetic oligonucleotide
ggaagaggagacacggaacaccaaggc

SEQ ID NO: 427396 - DNA, 27 bp, Artificial Sequence
  Description of Artificial Sequence: Synthetic oligonucleotide
gaagaggagacacggaacaccaaggcc

SEQ ID NO: 427397 - DNA, 27 bp, Artificial Sequence
  Description of Artificial Sequence: Synthetic oligonucleotide
aagaggagacacggaacaccaaggccc

SEQ ID NO: 427398 - DNA, 27 bp, Artificial Sequence
  Description of Artificial Sequence: Synthetic oligonucleotide
agaggagacacggaacaccaaggccca

SEQ ID NO: 427399 - DNA, 26 bp, Artificial Sequence
  Description of Artificial Sequence: Synthetic oligonucleotide
gaggagacacggaacaccaaggccca

SEQ ID NO: 427400 - DNA, 26 bp, Artificial Sequence
  Description of Artificial Sequence: Synthetic oligonucleotide
aggagacacggaacaccaaggcccac

SEQ ID NO: 427401 - DNA, 25 bp, Artificial Sequence
  Description of Artificial Sequence: Synthetic oligonucleotide
ggagacacggaacaccaaggcccac

SEQ ID NO: 427402 - DNA, 25 bp, Artificial Sequence
  Description of Artificial Sequence: Synthetic oligonucleotide
gagacacggaacaccaaggcccacg

SEQ ID NO: 427403 - DNA, 26 bp, Artificial Sequence
  Description of Artificial Sequence: Synthetic oligonucleotide
agacacggaacaccaaggcccacgca

SEQ ID NO: 427404 - DNA, 25 bp, Artificial Sequence
  Description of Artificial Sequence: Synthetic oligonucleotide
gacacggaacaccaaggcccacgca

SEQ ID NO: 427405 - DNA, 26 bp, Artificial Sequence
  Description of Artificial Sequence: Synthetic oligonucleotide
acacggaacaccaaggcccacgcaca

SEQ ID NO: 427406 - DNA, 25 bp, Artificial Sequence
  Description of Artificial Sequence: Synthetic oligonucleotide
cacggaacaccaaggcccacgcaca

SEQ ID NO: 427407 - DNA, 26 bp, Artificial Sequence
  Description of Artificial Sequence: Synthetic oligonucleotide
acggaacaccaaggcccacgcacaga

SEQ ID NO: 427408 - DNA, 25 bp, Artificial Sequence
  Description of Artificial Sequence: Synthetic oligonucleotide
cggaacaccaaggcccacgcacaga

SEQ ID NO: 427409 - DNA, 26 bp, Artificial Sequence
  Description of Artificial Sequence: Synthetic oligonucleotide
ggaacaccaaggcccacgcacagact

SEQ ID NO: 427410 - DNA, 27 bp, Artificial Sequence
  Description of Artificial Sequence: Synthetic oligonucleotide
gaacaccaaggcccacgcacagactga

SEQ ID NO: 427411 - DNA, 27 bp, Artificial Sequence
  Description of Artificial Sequence: Synthetic oligonucleotide
aacaccaaggcccacgcacagactgac

SEQ ID NO: 427412 - DNA, 27 bp, Artificial Sequence
  Description of Artificial Sequence: Synthetic oligonucleotide
acaccaaggcccacgcacagactgaca

SEQ ID NO: 427413 - DNA, 26 bp, Artificial Sequence
  Description of Artificial Sequence: Synthetic oligonucleotide
caccaaggcccacgcacagactgaca

SEQ ID NO: 427414 - DNA, 27 bp, Artificial Sequence
  Description of Artificial Sequence: Synthetic oligonucleotide
accaaggcccacgcacagactgacaga

SEQ ID NO: 427415 - DNA, 27 bp, Artificial Sequence
  Description of Artificial Sequence: Synthetic oligonucleotide
ccaaggcccacgcacagactgacagaa

SEQ ID NO: 427416 - DNA, 28 bp, Artificial Sequence
  Description of Artificial Sequence: Synthetic oligonucleotide
caaggcccacgcacagactgacagaatg

SEQ ID NO: 427417 - DNA, 30 bp, Artificial Sequence; identical to SEQ ID NO: 77536
  Description of Artificial Sequence: Synthetic oligonucleotide

SEQ ID NO: 427418 - DNA, 29 bp, Artificial Sequence
  Description of Artificial Sequence: Synthetic oligonucleotide
aggcccacgcacagactgacagaatgaac

SEQ ID NO: 427419 - DNA, 28 bp, Artificial Sequence
  Description of Artificial Sequence: Synthetic oligonucleotide
ggcccacgcacagactgacagaatgaac

SEQ ID NO: 427420 - DNA, 28 bp, Artificial Sequence
  Description of Artificial Sequence: Synthetic oligonucleotide
gcccacgcacagactgacagaatgaacc

SEQ ID NO: 427421 - DNA, 29 bp, Artificial Sequence
  Description of Artificial Sequence: Synthetic oligonucleotide
cccacgcacagactgacagaatgaacctg

SEQ ID NO: 427422 - DNA, 29 bp, Artificial Sequence
  Description of Artificial Sequence: Synthetic oligonucleotide
ccacgcacagactgacagaatgaacctgc

SEQ ID NO: 427423 - DNA, 30 bp, Artificial Sequence; identical to SEQ ID NO: 77542
  Description of Artificial Sequence: Synthetic oligonucleotide

SEQ ID NO: 427424 - DNA, 31 bp, Artificial Sequence; identical to SEQ ID NO: 77543
  Description of Artificial Sequence: Synthetic oligonucleotide

SEQ ID NO: 427425 - DNA, 30 bp, Artificial Sequence; identical to SEQ ID NO: 77544
  Description of Artificial Sequence: Synthetic oligonucleotide

SEQ ID NO: 427426 - DNA, 30 bp, Artificial Sequence; identical to SEQ ID NO: 77545
  Description of Artificial Sequence: Synthetic oligonucleotide

SEQ ID NO: 427427 - DNA, 30 bp, Artificial Sequence; identical to SEQ ID NO: 77546
  Description of Artificial Sequence: Synthetic oligonucleotide

SEQ ID NO: 427428 - DNA, 31 bp, Artificial Sequence; identical to SEQ ID NO: 77547
  Description of Artificial Sequence: Synthetic oligonucleotide

SEQ ID NO: 427429 - DNA, 30 bp, Artificial Sequence; identical to SEQ ID NO: 77548
  Description of Artificial Sequence: Synthetic oligonucleotide

SEQ ID NO: 427430 - DNA, 30 bp, Artificial Sequence; identical to SEQ ID NO: 77549
  Description of Artificial Sequence: Synthetic oligonucleotide

SEQ ID NO: 427431 - DNA, 29 bp, Artificial Sequence
  Description of Artificial Sequence: Synthetic oligonucleotide
gactgacagaatgaacctgcagaccctgc

SEQ ID NO: 427432 - DNA, 29 bp, Artificial Sequence
  Description of Artificial Sequence: Synthetic oligonucleotide
actgacagaatgaacctgcagaccctgcg

SEQ ID NO: 427433 - DNA, 28 bp, Artificial Sequence
  Description of Artificial Sequence: Synthetic oligonucleotide
ctgacagaatgaacctgcagaccctgcg

SEQ ID NO: 427434 - DNA, 28 bp, Artificial Sequence
  Description of Artificial Sequence: Synthetic oligonucleotide
tgacagaatgaacctgcagaccctgcgc

SEQ ID NO: 427435 - DNA, 27 bp, Artificial Sequence
  Description of Artificial Sequence: Synthetic oligonucleotide
gacagaatgaacctgcagaccctgcgc

SEQ ID NO: 427436 - DNA, 27 bp, Artificial Sequence
  Description of Artificial Sequence: Synthetic oligonucleotide
acagaatgaacctgcagaccctgcgcg

SEQ ID NO: 427437 - DNA, 26 bp, Artificial Sequence
  Description of Artificial Sequence: Synthetic oligonucleotide
cagaatgaacctgcagaccctgcgcg

SEQ ID NO: 427438 - DNA, 26 bp, Artificial Sequence
  Description of Artificial Sequence: Synthetic oligonucleotide
agaatgaacctgcagaccctgcgcgg

SEQ ID NO: 427439 - DNA, 25 bp, Artificial Sequence
  Description of Artificial Sequence: Synthetic oligonucleotide
gaatgaacctgcagaccctgcgcgg

SEQ ID NO: 427440 - DNA, 27 bp, Artificial Sequence
  Description of Artificial Sequence: Synthetic oligonucleotide
aatgaacctgcagaccctgcgcggcta

SEQ ID NO: 427441 - DNA, 26 bp, Artificial Sequence
  Description of Artificial Sequence: Synthetic oligonucleotide
atgaacctgcagaccctgcgcggcta

SEQ ID NO: 427442 - DNA, 25 bp, Artificial Sequence
  Description of Artificial Sequence: Synthetic oligonucleotide
tgaacctgcagaccctgcgcggcta

SEQ ID NO: 427443 - DNA, 24 bp, Artificial Sequence
  Description of Artificial Sequence: Synthetic oligonucleotide
gaacctgcagaccctgcgcggcta

SEQ ID NO: 427444 - DNA, 26 bp, Artificial Sequence
  Description of Artificial Sequence: Synthetic oligonucleotide
aacctgcagaccctgcgcggctacta

SEQ ID NO: 427445 - DNA, 25 bp, Artificial Sequence
  Description of Artificial Sequence: Synthetic oligonucleotide
acctgcagaccctgcgcggctacta

SEQ ID NO: 427446 - DNA, 24 bp, Artificial Sequence
  Description of Artificial Sequence: Synthetic oligonucleotide
cctgcagaccctgcgcggctacta

SEQ ID NO: 427447 - DNA, 26 bp, Artificial Sequence
  Description of Artificial Sequence: Synthetic oligonucleotide
ctgcagaccctgcgcggctactacaa

SEQ ID NO: 427448 - DNA, 26 bp, Artificial Sequence
  Description of Artificial Sequence: Synthetic oligonucleotide
tgcagaccctgcgcggctactacaac

SEQ ID NO: 427449 - DNA, 25 bp, Artificial Sequence
  Description of Artificial Sequence: Synthetic oligonucleotide
gcagaccctgcgcggctactacaac

SEQ ID NO: 427450 - DNA, 26 bp, Artificial Sequence
  Description of Artificial Sequence: Synthetic oligonucleotide
cagaccctgcgcggctactacaacca

SEQ ID NO: 427451 - DNA, 27 bp, Artificial Sequence
  Description of Artificial Sequence: Synthetic oligonucleotide
agaccctgcgcggctactacaaccaga

SEQ ID NO: 427452 - DNA, 27 bp, Artificial Sequence
  Description of Artificial Sequence: Synthetic oligonucleotide
ggctactacaaccagagcgaggccagt

SEQ ID NO: 427453 - DNA, 28 bp, Artificial Sequence
  Description of Artificial Sequence: Synthetic oligonucleotide
gctactacaaccagagcgaggccagttc

SEQ ID NO: 427454 - DNA, 29 bp, Artificial Sequence
  Description of Artificial Sequence: Synthetic oligonucleotide
ctactacaaccagagcgaggccagttctc

SEQ ID NO: 427455 - DNA, 30 bp, Artificial Sequence; identical to SEQ ID NO: 11901
  Description of Artificial Sequence: Synthetic oligonucleotide

SEQ ID NO: 427456 - DNA, 29 bp, Artificial Sequence
  Description of Artificial Sequence: Synthetic oligonucleotide
actacaaccagagcgaggccagttctcac

SEQ ID NO: 427457 - DNA, 28 bp, Artificial Sequence
  Description of Artificial Sequence: Synthetic oligonucleotide
ctacaaccagagcgaggccagttctcac

SEQ ID NO: 427458 - DNA, 29 bp, Artificial Sequence
  Description of Artificial Sequence: Synthetic oligonucleotide
tacaaccagagcgaggccagttctcacac

SEQ ID NO: 427459 - DNA, 28 bp, Artificial Sequence
  Description of Artificial Sequence: Synthetic oligonucleotide
acaaccagagcgaggccagttctcacac

SEQ ID NO: 427460 - DNA, 27 bp, Artificial Sequence
  Description of Artificial Sequence: Synthetic oligonucleotide
caaccagagcgaggccagttctcacac

SEQ ID NO: 427461 - DNA, 27 bp, Artificial Sequence
  Description of Artificial Sequence: Synthetic oligonucleotide
aaccagagcgaggccagttctcacacc

SEQ ID NO: 427462 - DNA, 26 bp, Artificial Sequence
  Description of Artificial Sequence: Synthetic oligonucleotide
accagagcgaggccagttctcacacc

SEQ ID NO: 427463 - DNA, 25 bp, Artificial Sequence
  Description of Artificial Sequence: Synthetic oligonucleotide
ccagagcgaggccagttctcacacc

SEQ ID NO: 427464 - DNA, 26 bp, Artificial Sequence
  Description of Artificial Sequence: Synthetic oligonucleotide
cagagcgaggccagttctcacaccct

SEQ ID NO: 427465 - DNA, 26 bp, Artificial Sequence
  Description of Artificial Sequence: Synthetic oligonucleotide
agagcgaggccagttctcacaccctc

SEQ ID NO: 427466 - DNA, 25 bp, Artificial Sequence
  Description of Artificial Sequence: Synthetic oligonucleotide
gagcgaggccagttctcacaccctc

SEQ ID NO: 427467 - DNA, 26 bp, Artificial Sequence
  Description of Artificial Sequence: Synthetic oligonucleotide
agcgaggccagttctcacaccctcca

SEQ ID NO: 427468 - DNA, 25 bp, Artificial Sequence
  Description of Artificial Sequence: Synthetic oligonucleotide
gcgaggccagttctcacaccctcca

SEQ ID NO: 427469 - DNA, 26 bp, Artificial Sequence
  Description of Artificial Sequence: Synthetic oligonucleotide
cgaggccagttctcacaccctccagt

SEQ ID NO: 427470 - DNA, 26 bp, Artificial Sequence
  Description of Artificial Sequence: Synthetic oligonucleotide
gaggccagttctcacaccctccagtg

SEQ ID NO: 427471 - DNA, 27 bp, Artificial Sequence
  Description of Artificial Sequence: Synthetic oligonucleotide
aggccagttctcacaccctccagtgga

SEQ ID NO: 427472 - DNA, 27 bp, Artificial Sequence
  Description of Artificial Sequence: Synthetic oligonucleotide
ggccagttctcacaccctccagtggat

SEQ ID NO: 427473 - DNA, 27 bp, Artificial Sequence
  Description of Artificial Sequence: Synthetic oligonucleotide
gccagttctcacaccctccagtggatg

SEQ ID NO: 427474 - DNA, 30 bp, Artificial Sequence; identical to SEQ ID NO: 77582
  Description of Artificial Sequence: Synthetic oligonucleotide

SEQ ID NO: 427475 - DNA, 30 bp, Artificial Sequence; identical to SEQ ID NO: 77583
  Description of Artificial Sequence: Synthetic oligonucleotide

SEQ ID NO: 427476 - DNA, 30 bp, Artificial Sequence; identical to SEQ ID NO: 77584
  Description of Artificial Sequence: Synthetic oligonucleotide

SEQ ID NO: 427477 - DNA, 29 bp, Artificial Sequence
  Description of Artificial Sequence: Synthetic oligonucleotide
gttctcacaccctccagtggatgattggc

SEQ ID NO: 427478 - DNA, 30 bp, Artificial Sequence; identical to SEQ ID NO: 16146
  Description of Artificial Sequence: Synthetic oligonucleotide

SEQ ID NO: 427479 - DNA, 29 bp, Artificial Sequence
  Description of Artificial Sequence: Synthetic oligonucleotide
tctcacaccctccagtggatgattggctg

SEQ ID NO: 427480 - DNA, 28 bp, Artificial Sequence
  Description of Artificial Sequence: Synthetic oligonucleotide
ctcacaccctccagtggatgattggctg

SEQ ID NO: 427481 - DNA, 28 bp, Artificial Sequence
  Description of Artificial Sequence: Synthetic oligonucleotide
tcacaccctccagtggatgattggctgc

SEQ ID NO: 427482 - DNA, 27 bp, Artificial Sequence
  Description of Artificial Sequence: Synthetic oligonucleotide
cacaccctccagtggatgattggctgc

SEQ ID NO: 427483 - DNA, 27 bp, Artificial Sequence
  Description of Artificial Sequence: Synthetic oligonucleotide
acaccctccagtggatgattggctgcg

SEQ ID NO: 427484 - DNA, 27 bp, Artificial Sequence
  Description of Artificial Sequence: Synthetic oligonucleotide
caccctccagtggatgattggctgcga

SEQ ID NO: 427485 - DNA, 27 bp, Artificial Sequence
  Description of Artificial Sequence: Synthetic oligonucleotide
accctccagtggatgattggctgcgac

SEQ ID NO: 427486 - DNA, 26 bp, Artificial Sequence
  Description of Artificial Sequence: Synthetic oligonucleotide
ccctccagtggatgattggctgcgac

SEQ ID NO: 427487 - DNA, 27 bp, Artificial Sequence
  Description of Artificial Sequence: Synthetic oligonucleotide
cctccagtggatgattggctgcgacct

SEQ ID NO: 427488 - DNA, 27 bp, Artificial Sequence
  Description of Artificial Sequence: Synthetic oligonucleotide
ctccagtggatgattggctgcgacctg

SEQ ID NO: 427489 - DNA, 27 bp, Artificial Sequence
  Description of Artificial Sequence: Synthetic oligonucleotide
tccagtggatgattggctgcgacctgg

SEQ ID NO: 427490 - DNA, 26 bp, Artificial Sequence
  Description of Artificial Sequence: Synthetic oligonucleotide
ccagtggatgattggctgcgacctgg

SEQ ID NO: 427491 - DNA, 26 bp, Artificial Sequence
  Description of Artificial Sequence: Synthetic oligonucleotide
cagtggatgattggctgcgacctggg

SEQ ID NO: 427492 - DNA, 27 bp, Artificial Sequence
  Description of Artificial Sequence: Synthetic oligonucleotide
agtggatgattggctgcgacctggggt

SEQ ID NO: 427493 - DNA, 26 bp, Artificial Sequence
  Description of Artificial Sequence: Synthetic oligonucleotide
gtggatgattggctgcgacctggggt

SEQ ID NO: 427494 - DNA, 26 bp, Artificial Sequence
  Description of Artificial Sequence: Synthetic oligonucleotide
tggatgattggctgcgacctggggtc

SEQ ID NO: 427495 - DNA, 25 bp, Artificial Sequence
  Description of Artificial Sequence: Synthetic oligonucleotide
ggatgattggctgcgacctggggtc

SEQ ID NO: 427496 - DNA, 25 bp, Artificial Sequence
  Description of Artificial Sequence: Synthetic oligonucleotide
gatgattggctgcgacctggggtcc

SEQ ID NO: 427497 - DNA, 26 bp, Artificial Sequence
  Description of Artificial Sequence: Synthetic oligonucleotide
atgattggctgcgacctggggtccga

SEQ ID NO: 427498 - DNA, 25 bp, Artificial Sequence
  Description of Artificial Sequence: Synthetic oligonucleotide
tgattggctgcgacctggggtccga

SEQ ID NO: 427499 - DNA, 24 bp, Artificial Sequence
  Description of Artificial Sequence: Synthetic oligonucleotide
gattggctgcgacctggggtccga

SEQ ID NO: 427500 - DNA, 24 bp, Artificial Sequence
  Description of Artificial Sequence: Synthetic oligonucleotide
attggctgcgacctggggtccgac

SEQ ID NO: 427501 - DNA, 23 bp, Artificial Sequence
  Description of Artificial Sequence: Synthetic oligonucleotide
ttggctgcgacctggggtccgac

SEQ ID NO: 427502 - DNA, 22 bp, Artificial Sequence
  Description of Artificial Sequence: Synthetic oligonucleotide
tggctgcgacctggggtccgac

SEQ ID NO: 427503 - DNA, 21 bp, Artificial Sequence
  Description of Artificial Sequence: Synthetic oligonucleotide
ggctgcgacctggggtccgac

SEQ ID NO: 427504 - DNA, 21 bp, Artificial Sequence
  Description of Artificial Sequence: Synthetic oligonucleotide
gctgcgacctggggtccgacg

SEQ ID NO: 427505 - DNA, 22 bp, Artificial Sequence
  Description of Artificial Sequence: Synthetic oligonucleotide
ctgcgacctggggtccgacgga

SEQ ID NO: 427506 - DNA, 22 bp, Artificial Sequence
  Description of Artificial Sequence: Synthetic oligonucleotide
tgcgacctggggtccgacggac

SEQ ID NO: 427507 - DNA, 21 bp, Artificial Sequence
  Description of Artificial Sequence: Synthetic oligonucleotide
gcgacctggggtccgacggac

SEQ ID NO: 427508 - DNA, 21 bp, Artificial Sequence
  Description of Artificial Sequence: Synthetic oligonucleotide
cgacctggggtccgacggacg

SEQ ID NO: 427509 - DNA, 21 bp, Artificial Sequence
  Description of Artificial Sequence: Synthetic oligonucleotide
gacctggggtccgacggacgc

SEQ ID NO: 427510 - DNA, 22 bp, Artificial Sequence
  Description of Artificial Sequence: Synthetic oligonucleotide
acctggggtccgacggacgcct

SEQ ID NO: 427511 - DNA, 21 bp, Artificial Sequence
  Description of Artificial Sequence: Synthetic oligonucleotide
cctggggtccgacggacgcct

SEQ ID NO: 427512 - DNA, 21 bp, Artificial Sequence
  Description of Artificial Sequence: Synthetic oligonucleotide
ctggggtccgacggacgcctc

SEQ ID NO: 427513 - DNA, 22 bp, Artificial Sequence
  Description of Artificial Sequence: Synthetic oligonucleotide
tggggtccgacggacgcctcct

SEQ ID NO: 427514 - DNA, 21 bp, Artificial Sequence
  Description of Artificial Sequence: Synthetic oligonucleotide
ggggtccgacggacgcctcct

SEQ ID NO: 427515 - DNA, 21 bp, Artificial Sequence
  Description of Artificial Sequence: Synthetic oligonucleotide
gggtccgacggacgcctcctc

SEQ ID NO: 427516 - DNA, 21 bp, Artificial Sequence
  Description of Artificial Sequence: Synthetic oligonucleotide
ggtccgacggacgcctcctcc

SEQ ID NO: 427517 - DNA, 21 bp, Artificial Sequence
  Description of Artificial Sequence: Synthetic oligonucleotide
gtccgacggacgcctcctccg

SEQ ID NO: 427518 - DNA, 21 bp, Artificial Sequence
  Description of Artificial Sequence: Synthetic oligonucleotide
tccgacggacgcctcctccgc

SEQ ID NO: 427519 - DNA, 24 bp, Artificial Sequence
  Description of Artificial Sequence: Synthetic oligonucleotide
ggacgcctcctccgcgggtatgaa

SEQ ID NO: 427520 - DNA, 25 bp, Artificial Sequence
  Description of Artificial Sequence: Synthetic oligonucleotide
gacgcctcctccgcgggtatgaaca

SEQ ID NO: 427521 - DNA, 27 bp, Artificial Sequence
  Description of Artificial Sequence: Synthetic oligonucleotide
acgcctcctccgcgggtatgaacagta

SEQ ID NO: 427522 - DNA, 27 bp, Artificial Sequence
  Description of Artificial Sequence: Synthetic oligonucleotide
cgcctcctccgcgggtatgaacagtat

SEQ ID NO: 427523 - DNA, 27 bp, Artificial Sequence
  Description of Artificial Sequence: Synthetic oligonucleotide
gcctcctccgcgggtatgaacagtatg

SEQ ID NO: 427524 - DNA, 27 bp, Artificial Sequence
  Description of Artificial Sequence: Synthetic oligonucleotide
cctcctccgcgggtatgaacagtatgc

SEQ ID NO: 427525 - DNA, 27 bp, Artificial Sequence
  Description of Artificial Sequence: Synthetic oligonucleotide
ctcctccgcgggtatgaacagtatgcc

SEQ ID NO: 427526 - DNA, 29 bp, Artificial Sequence
  Description of Artificial Sequence: Synthetic oligonucleotide
tcctccgcgggtatgaacagtatgcctac

SEQ ID NO: 427527 - DNA, 28 bp, Artificial Sequence
  Description of Artificial Sequence: Synthetic oligonucleotide
cctccgcgggtatgaacagtatgcctac

SEQ ID NO: 427528 - DNA, 28 bp, Artificial Sequence
  Description of Artificial Sequence: Synthetic oligonucleotide
ctccgcgggtatgaacagtatgcctacg

SEQ ID NO: 427529 - DNA, 30 bp, Artificial Sequence; identical to SEQ ID NO: 77624
  Description of Artificial Sequence: Synthetic oligonucleotide

SEQ ID NO: 427530 - DNA, 29 bp, Artificial Sequence
  Description of Artificial Sequence: Synthetic oligonucleotide
ccgcgggtatgaacagtatgcctacgatg

SEQ ID NO: 427531 - DNA, 29 bp, Artificial Sequence
  Description of Artificial Sequence: Synthetic oligonucleotide
cgcgggtatgaacagtatgcctacgatgg

SEQ ID NO: 427532 - DNA, 29 bp, Artificial Sequence
  Description of Artificial Sequence: Synthetic oligonucleotide
gcgggtatgaacagtatgcctacgatggc

SEQ ID NO: 427533 - DNA, 31 bp, Artificial Sequence; identical to SEQ ID NO: 77628
  Description of Artificial Sequence: Synthetic oligonucleotide

SEQ ID NO: 427534 - DNA, 31 bp, Artificial Sequence; identical to SEQ ID NO: 77629
  Description of Artificial Sequence: Synthetic oligonucleotide

SEQ ID NO: 427535 - DNA, 35 bp, Artificial Sequence; identical to SEQ ID NO: 77630
  Description of Artificial Sequence: Synthetic oligonucleotide

SEQ ID NO: 427536 - DNA, 35 bp, Artificial Sequence; identical to SEQ ID NO: 77631
  Description of Artificial Sequence: Synthetic oligonucleotide

SEQ ID NO: 427537 - DNA, 36 bp, Artificial Sequence; identical to SEQ ID NO: 77632
  Description of Artificial Sequence: Synthetic oligonucleotide

SEQ ID NO: 427538 - DNA, 35 bp, Artificial Sequence; identical to SEQ ID NO: 77633
  Description of Artificial Sequence: Synthetic oligonucleotide

SEQ ID NO: 427539 - DNA, 34 bp, Artificial Sequence; identical to SEQ ID NO: 77634
  Description of Artificial Sequence: Synthetic oligonucleotide

SEQ ID NO: 427540 - DNA, 33 bp, Artificial Sequence; identical to SEQ ID NO: 77635
  Description of Artificial Sequence: Synthetic oligonucleotide

SEQ ID NO: 427541 - DNA, 33 bp, Artificial Sequence; identical to SEQ ID NO: 77636
  Description of Artificial Sequence: Synthetic oligonucleotide

SEQ ID NO: 427542 - DNA, 32 bp, Artificial Sequence; identical to SEQ ID NO: 77637
  Description of Artificial Sequence: Synthetic oligonucleotide

SEQ ID NO: 427543 - DNA, 31 bp, Artificial Sequence; identical to SEQ ID NO: 77638
  Description of Artificial Sequence: Synthetic oligonucleotide

SEQ ID NO: 427544 - DNA, 31 bp, Artificial Sequence; identical to SEQ ID NO: 77639
  Description of Artificial Sequence: Synthetic oligonucleotide

SEQ ID NO: 427545 - DNA, 30 bp, Artificial Sequence; identical to SEQ ID NO: 77640
  Description of Artificial Sequence: Synthetic oligonucleotide

SEQ ID NO: 427546 - DNA, 30 bp, Artificial Sequence; identical to SEQ ID NO: 77641
  Description of Artificial Sequence: Synthetic oligonucleotide

SEQ ID NO: 427547 - DNA, 29 bp, Artificial Sequence
  Description of Artificial Sequence: Synthetic oligonucleotide
atgcctacgatggcaaggattacctcgcc

SEQ ID NO: 427548 - DNA, 28 bp, Artificial Sequence
  Description of Artificial Sequence: Synthetic oligonucleotide
tgcctacgatggcaaggattacctcgcc

SEQ ID NO: 427549 - DNA, 27 bp, Artificial Sequence
  Description of Artificial Sequence: Synthetic oligonucleotide
gcctacgatggcaaggattacctcgcc

SEQ ID NO: 427550 - DNA, 27 bp, Artificial Sequence
  Description of Artificial Sequence: Synthetic oligonucleotide
cctacgatggcaaggattacctcgccc

SEQ ID NO: 427551 - DNA, 28 bp, Artificial Sequence
  Description of Artificial Sequence: Synthetic oligonucleotide
ctacgatggcaaggattacctcgccctg

SEQ ID NO: 427552 - DNA, 30 bp, Artificial Sequence; identical to SEQ ID NO: 77647
  Description of Artificial Sequence: Synthetic oligonucleotide

SEQ ID NO: 427553 - DNA, 29 bp, Artificial Sequence
  Description of Artificial Sequence: Synthetic oligonucleotide
acgatggcaaggattacctcgccctgaac

SEQ ID NO: 427554 - DNA, 28 bp, Artificial Sequence
  Description of Artificial Sequence: Synthetic oligonucleotide
cgatggcaaggattacctcgccctgaac

SEQ ID NO: 427555 - DNA, 28 bp, Artificial Sequence
  Description of Artificial Sequence: Synthetic oligonucleotide
gatggcaaggattacctcgccctgaacg

SEQ ID NO: 427556 - DNA, 29 bp, Artificial Sequence
  Description of Artificial Sequence: Synthetic oligonucleotide
atggcaaggattacctcgccctgaacgag

SEQ ID NO: 427557 - DNA, 28 bp, Artificial Sequence
  Description of Artificial Sequence: Synthetic oligonucleotide
tggcaaggattacctcgccctgaacgag

SEQ ID NO: 427558 - DNA, 27 bp, Artificial Sequence
  Description of Artificial Sequence: Synthetic oligonucleotide
ggcaaggattacctcgccctgaacgag

SEQ ID NO: 427559 - DNA, 27 bp, Artificial Sequence
  Description of Artificial Sequence: Synthetic oligonucleotide
gcaaggattacctcgccctgaacgagg

SEQ ID NO: 427560 - DNA, 28 bp, Artificial Sequence
  Description of Artificial Sequence: Synthetic oligonucleotide
caaggattacctcgccctgaacgaggac

SEQ ID NO: 427561 - DNA, 28 bp, Artificial Sequence
  Description of Artificial Sequence: Synthetic oligonucleotide
aaggattacctcgccctgaacgaggacc

SEQ ID NO: 427562 - DNA, 27 bp, Artificial Sequence
  Description of Artificial Sequence: Synthetic oligonucleotide
aggattacctcgccctgaacgaggacc

SEQ ID NO: 427563 - DNA, 27 bp, Artificial Sequence
  Description of Artificial Sequence: Synthetic oligonucleotide
ggattacctcgccctgaacgaggacct

SEQ ID NO: 427564 - DNA, 27 bp, Artificial Sequence
  Description of Artificial Sequence: Synthetic oligonucleotide
gattacctcgccctgaacgaggacctg

SEQ ID NO: 427565 - DNA, 27 bp, Artificial Sequence
  Description of Artificial Sequence: Synthetic oligonucleotide
attacctcgccctgaacgaggacctgc

SEQ ID NO: 427566 - DNA, 26 bp, Artificial Sequence
  Description of Artificial Sequence: Synthetic oligonucleotide
ttacctcgccctgaacgaggacctgc

SEQ ID NO: 427567 - DNA, 25 bp, Artificial Sequence
  Description of Artificial Sequence: Synthetic oligonucleotide
tacctcgccctgaacgaggacctgc

SEQ ID NO: 427568 - DNA, 24 bp, Artificial Sequence
  Description of Artificial Sequence: Synthetic oligonucleotide
acctcgccctgaacgaggacctgc

SEQ ID NO: 427569 - DNA, 23 bp, Artificial Sequence
  Description of Artificial Sequence: Synthetic oligonucleotide
cctcgccctgaacgaggacctgc

SEQ ID NO: 427570 - DNA, 23 bp, Artificial Sequence
  Description of Artificial Sequence: Synthetic oligonucleotide
ctcgccctgaacgaggacctgcg

SEQ ID NO: 427571 - DNA, 23 bp, Artificial Sequence
  Description of Artificial Sequence: Synthetic oligonucleotide
aggacctgcgctcctggaccgca

SEQ ID NO: 427572 - DNA, 22 bp, Artificial Sequence
  Description of Artificial Sequence: Synthetic oligonucleotide
ggacctgcgctcctggaccgca

SEQ ID NO: 427573 - DNA, 22 bp, Artificial Sequence
  Description of Artificial Sequence: Synthetic oligonucleotide
gacctgcgctcctggaccgcag

SEQ ID NO: 427574 - DNA, 22 bp, Artificial Sequence
  Description of Artificial Sequence: Synthetic oligonucleotide
acctgcgctcctggaccgcagc

SEQ ID NO: 427575 - DNA, 21 bp, Artificial Sequence
  Description of Artificial Sequence: Synthetic oligonucleotide
cctgcgctcctggaccgcagc

SEQ ID NO: 427576 - DNA, 21 bp, Artificial Sequence
  Description of Artificial Sequence: Synthetic oligonucleotide
ctgcgctcctggaccgcagcg

SEQ ID NO: 427577 - DNA, 22 bp, Artificial Sequence
  Description of Artificial Sequence: Synthetic oligonucleotide
tgcgctcctggaccgcagcgga

SEQ ID NO: 427578 - DNA, 21 bp, Artificial Sequence
  Description of Artificial Sequence: Synthetic oligonucleotide
gcgctcctggaccgcagcgga

SEQ ID NO: 427579 - DNA, 22 bp, Artificial Sequence
  Description of Artificial Sequence: Synthetic oligonucleotide
cgctcctggaccgcagcggaca

SEQ ID NO: 427580 - DNA, 23 bp, Artificial Sequence
  Description of Artificial Sequence: Synthetic oligonucleotide
gctcctggaccgcagcggacact

SEQ ID NO: 427581 - DNA, 23 bp, Artificial Sequence
  Description of Artificial Sequence: Synthetic oligonucleotide
ctcctggaccgcagcggacactg

SEQ ID NO: 427582 - DNA, 23 bp, Artificial Sequence
  Description of Artificial Sequence: Synthetic oligonucleotide
tcctggaccgcagcggacactgc

SEQ ID NO: 427583 - DNA, 22 bp, Artificial Sequence
  Description of Artificial Sequence: Synthetic oligonucleotide
cctggaccgcagcggacactgc

SEQ ID NO: 427584 - DNA, 22 bp, Artificial Sequence
  Description of Artificial Sequence: Synthetic oligonucleotide
ctggaccgcagcggacactgcg

SEQ ID NO: 427585 - DNA, 22 bp, Artificial Sequence
  Description of Artificial Sequence: Synthetic oligonucleotide
tggaccgcagcggacactgcgg

SEQ ID NO: 427586 - DNA, 21 bp, Artificial Sequence
  Description of Artificial Sequence: Synthetic oligonucleotide
ggaccgcagcggacactgcgg

SEQ ID NO: 427587 - DNA, 22 bp, Artificial Sequence
  Description of Artificial Sequence: Synthetic oligonucleotide
gaccgcagcggacactgcggct

SEQ ID NO: 427588 - DNA, 23 bp, Artificial Sequence
  Description of Artificial Sequence: Synthetic oligonucleotide
accgcagcggacactgcggctca

SEQ ID NO: 427589 - DNA, 22 bp, Artificial Sequence
  Description of Artificial Sequence: Synthetic oligonucleotide
ccgcagcggacactgcggctca

SEQ ID NO: 427590 - DNA, 24 bp, Artificial Sequence
  Description of Artificial Sequence: Synthetic oligonucleotide
cgcagcggacactgcggctcagat

SEQ ID NO: 427591 - DNA, 25 bp, Artificial Sequence
  Description of Artificial Sequence: Synthetic oligonucleotide
gcagcggacactgcggctcagatct

SEQ ID NO: 427592 - DNA, 25 bp, Artificial Sequence
  Description of Artificial Sequence: Synthetic oligonucleotide
cagcggacactgcggctcagatctc

SEQ ID NO: 427593 - DNA, 27 bp, Artificial Sequence
  Description of Artificial Sequence: Synthetic oligonucleotide
agcggacactgcggctcagatctccaa

SEQ ID NO: 427594 - DNA, 26 bp, Artificial Sequence
  Description of Artificial Sequence: Synthetic oligonucleotide
gcggacactgcggctcagatctccaa

SEQ ID NO: 427595 - DNA, 26 bp, Artificial Sequence
  Description of Artificial Sequence: Synthetic oligonucleotide
cggacactgcggctcagatctccaag

SEQ ID NO: 427596 - DNA, 26 bp, Artificial Sequence
  Description of Artificial Sequence: Synthetic oligonucleotide
ggacactgcggctcagatctccaagc

SEQ ID NO: 427597 - DNA, 26 bp, Artificial Sequence
  Description of Artificial Sequence: Synthetic oligonucleotide
gacactgcggctcagatctccaagcg

SEQ ID NO: 427598 - DNA, 27 bp, Artificial Sequence
  Description of Artificial Sequence: Synthetic oligonucleotide
acactgcggctcagatctccaagcgca

SEQ ID NO: 427599 - DNA, 27 bp, Artificial Sequence
  Description of Artificial Sequence: Synthetic oligonucleotide
cactgcggctcagatctccaagcgcaa

SEQ ID NO: 427600 - DNA, 27 bp, Artificial Sequence
  Description of Artificial Sequence: Synthetic oligonucleotide
actgcggctcagatctccaagcgcaag

SEQ ID NO: 427601 - DNA, 27 bp, Artificial Sequence
  Description of Artificial Sequence: Synthetic oligonucleotide
ctgcggctcagatctccaagcgcaagt

SEQ ID NO: 427602 - DNA, 27 bp, Artificial Sequence
  Description of Artificial Sequence: Synthetic oligonucleotide
tgcggctcagatctccaagcgcaagtg

SEQ ID NO: 427603 - DNA, 27 bp, Artificial Sequence
  Description of Artificial Sequence: Synthetic oligonucleotide
gcggctcagatctccaagcgcaagtgt

SEQ ID NO: 427604 - DNA, 27 bp, Artificial Sequence
  Description of Artificial Sequence: Synthetic oligonucleotide
cggctcagatctccaagcgcaagtgtg

SEQ ID NO: 427605 - DNA, 28 bp, Artificial Sequence
  Description of Artificial Sequence: Synthetic oligonucleotide
ggctcagatctccaagcgcaagtgtgag

SEQ ID NO: 427606 - DNA, 28 bp, Artificial Sequence
  Description of Artificial Sequence: Synthetic oligonucleotide
gctcagatctccaagcgcaagtgtgagg

SEQ ID NO: 427607 - DNA, 28 bp, Artificial Sequence
  Description of Artificial Sequence: Synthetic oligonucleotide
ctcagatctccaagcgcaagtgtgaggc

SEQ ID NO: 427608 - DNA, 28 bp, Artificial Sequence
  Description of Artificial Sequence: Synthetic oligonucleotide
tcagatctccaagcgcaagtgtgaggcg

SEQ ID NO: 427609 - DNA, 27 bp, Artificial Sequence
  Description of Artificial Sequence: Synthetic oligonucleotide
cagatctccaagcgcaagtgtgaggcg

SEQ ID NO: 427610 - DNA, 27 bp, Artificial Sequence
  Description of Artificial Sequence: Synthetic oligonucleotide
agatctccaagcgcaagtgtgaggcgg

SEQ ID NO: 427611 - DNA, 26 bp, Artificial Sequence
  Description of Artificial Sequence: Synthetic oligonucleotide
gatctccaagcgcaagtgtgaggcgg

SEQ ID NO: 427612 - DNA, 26 bp, Artificial Sequence
  Description of Artificial Sequence: Synthetic oligonucleotide
atctccaagcgcaagtgtgaggcggc

SEQ ID NO: 427613 - DNA, 25 bp, Artificial Sequence
  Description of Artificial Sequence: Synthetic oligonucleotide
tctccaagcgcaagtgtgaggcggc

SEQ ID NO: 427614 - DNA, 24 bp, Artificial Sequence
  Description of Artificial Sequence: Synthetic oligonucleotide
ctccaagcgcaagtgtgaggcggc

SEQ ID NO: 427615 - DNA, 27 bp, Artificial Sequence
  Description of Artificial Sequence: Synthetic oligonucleotide
tccaagcgcaagtgtgaggcggccaat

SEQ ID NO: 427616 - DNA, 26 bp, Artificial Sequence
  Description of Artificial Sequence: Synthetic oligonucleotide
ccaagcgcaagtgtgaggcggccaat

SEQ ID NO: 427617 - DNA, 27 bp, Artificial Sequence
  Description of Artificial Sequence: Synthetic oligonucleotide
caagcgcaagtgtgaggcggccaatgt

SEQ ID NO: 427618 - DNA, 27 bp, Artificial Sequence
  Description of Artificial Sequence: Synthetic oligonucleotide
aagcgcaagtgtgaggcggccaatgtg

SEQ ID NO: 427619 - DNA, 26 bp, Artificial Sequence
  Description of Artificial Sequence: Synthetic oligonucleotide
agcgcaagtgtgaggcggccaatgtg

SEQ ID NO: 427620 - DNA, 25 bp, Artificial Sequence
  Description of Artificial Sequence: Synthetic oligonucleotide
gcgcaagtgtgaggcggccaatgtg

SEQ ID NO: 427621 - DNA, 25 bp, Artificial Sequence
  Description of Artificial Sequence: Synthetic oligonucleotide
cgcaagtgtgaggcggccaatgtgg

SEQ ID NO: 427622 - DNA, 26 bp, Artificial Sequence
  Description of Artificial Sequence: Synthetic oligonucleotide
gcaagtgtgaggcggccaatgtggct

SEQ ID NO: 427623 - DNA, 27 bp, Artificial Sequence
  Description of Artificial Sequence: Synthetic oligonucleotide
caagtgtgaggcggccaatgtggctga

SEQ ID NO: 427624 - DNA, 28 bp, Artificial Sequence
  Description of Artificial Sequence: Synthetic oligonucleotide
aagtgtgaggcggccaatgtggctgaac

SEQ ID NO: 427625 - DNA, 27 bp, Artificial Sequence
  Description of Artificial Sequence: Synthetic oligonucleotide
agtgtgaggcggccaatgtggctgaac

SEQ ID NO: 427626 - DNA, 27 bp, Artificial Sequence
  Description of Artificial Sequence: Synthetic oligonucleotide
gtgtgaggcggccaatgtggctgaaca

SEQ ID NO: 427627 - DNA, 29 bp, Artificial Sequence
  Description of Artificial Sequence: Synthetic oligonucleotide
tgtgaggcggccaatgtggctgaacaaag

SEQ ID NO: 427628 - DNA, 28 bp, Artificial Sequence
  Description of Artificial Sequence: Synthetic oligonucleotide
gtgaggcggccaatgtggctgaacaaag

SEQ ID NO: 427629 - DNA, 28 bp, Artificial Sequence
  Description of Artificial Sequence: Synthetic oligonucleotide
tgaggcggccaatgtggctgaacaaagg

SEQ ID NO: 427630 - DNA, 27 bp, Artificial Sequence
  Description of Artificial Sequence: Synthetic oligonucleotide
gaggcggccaatgtggctgaacaaagg

SEQ ID NO: 427631 - DNA, 28 bp, Artificial Sequence
  Description of Artificial Sequence: Synthetic oligonucleotide
aggcggccaatgtggctgaacaaaggag

SEQ ID NO: 427632 - DNA, 27 bp, Artificial Sequence
  Description of Artificial Sequence: Synthetic oligonucleotide
ggcggccaatgtggctgaacaaaggag

SEQ ID NO: 427633 - DNA, 28 bp, Artificial Sequence
  Description of Artificial Sequence: Synthetic oligonucleotide
gcggccaatgtggctgaacaaaggagag

SEQ ID NO: 427634 - DNA, 28 bp, Artificial Sequence
  Description of Artificial Sequence: Synthetic oligonucleotide
cggccaatgtggctgaacaaaggagagc

SEQ ID NO: 427635 - DNA, 28 bp, Artificial Sequence
  Description of Artificial Sequence: Synthetic oligonucleotide
ggccaatgtggctgaacaaaggagagcc

SEQ ID NO: 427636 - DNA, 30 bp, Artificial Sequence; identical to SEQ ID NO: 77731
  Description of Artificial Sequence: Synthetic oligonucleotide

SEQ ID NO: 427637 - DNA, 30 bp, Artificial Sequence; identical to SEQ ID NO: 77732
  Description of Artificial Sequence: Synthetic oligonucleotide

SEQ ID NO: 427638 - DNA, 31 bp, Artificial Sequence; identical to SEQ ID NO: 77733
  Description of Artificial Sequence: Synthetic oligonucleotide

SEQ ID NO: 427639 - DNA, 31 bp, Artificial Sequence; identical to SEQ ID NO: 77734
  Description of Artificial Sequence: Synthetic oligonucleotide

SEQ ID NO: 427640 - DNA, 30 bp, Artificial Sequence; identical to SEQ ID NO: 77735
  Description of Artificial Sequence: Synthetic oligonucleotide

SEQ ID NO: 427641 - DNA, 29 bp, Artificial Sequence
  Description of Artificial Sequence: Synthetic oligonucleotide
tgtggctgaacaaaggagagcctacctgg

SEQ ID NO: 427642 - DNA, 28 bp, Artificial Sequence
  Description of Artificial Sequence: Synthetic oligonucleotide
gtggctgaacaaaggagagcctacctgg

SEQ ID NO: 427643 - DNA, 29 bp, Artificial Sequence
  Description of Artificial Sequence: Synthetic oligonucleotide
tggctgaacaaaggagagcctacctggag

SEQ ID NO: 427644 - DNA, 28 bp, Artificial Sequence
  Description of Artificial Sequence: Synthetic oligonucleotide
ggctgaacaaaggagagcctacctggag

SEQ ID NO: 427645 - DNA, 28 bp, Artificial Sequence
  Description of Artificial Sequence: Synthetic oligonucleotide
gctgaacaaaggagagcctacctggagg

SEQ ID NO: 427646 - DNA, 28 bp, Artificial Sequence
  Description of Artificial Sequence: Synthetic oligonucleotide
ctgaacaaaggagagcctacctggaggg

SEQ ID NO: 427647 - DNA, 28 bp, Artificial Sequence
  Description of Artificial Sequence: Synthetic oligonucleotide
tgaacaaaggagagcctacctggagggc

SEQ ID NO: 427648 - DNA, 27 bp, Artificial Sequence
  Description of Artificial Sequence: Synthetic oligonucleotide
gaacaaaggagagcctacctggagggc

SEQ ID NO: 427649 - DNA, 28 bp, Artificial Sequence
  Description of Artificial Sequence: Synthetic oligonucleotide
aacaaaggagagcctacctggagggcac

SEQ ID NO: 427650 - DNA, 27 bp, Artificial Sequence
  Description of Artificial Sequence: Synthetic oligonucleotide
acaaaggagagcctacctggagggcac

SEQ ID NO: 427651 - DNA, 26 bp, Artificial Sequence
  Description of Artificial Sequence: Synthetic oligonucleotide
caaaggagagcctacctggagggcac

SEQ ID NO: 427652 - DNA, 27 bp, Artificial Sequence
  Description of Artificial Sequence: Synthetic oligonucleotide
aaaggagagcctacctggagggcacgt

SEQ ID NO: 427653 - DNA, 26 bp, Artificial Sequence
  Description of Artificial Sequence: Synthetic oligonucleotide
aaggagagcctacctggagggcacgt

SEQ ID NO: 427654 - DNA, 25 bp, Artificial Sequence
  Description of Artificial Sequence: Synthetic oligonucleotide
aggagagcctacctggagggcacgt

SEQ ID NO: 427655 - DNA, 23 bp, Artificial Sequence
  Description of Artificial Sequence: Synthetic oligonucleotide
ggcacgtgcgtggagtggctcca

SEQ ID NO: 427656 - DNA, 24 bp, Artificial Sequence
  Description of Artificial Sequence: Synthetic oligonucleotide
gcacgtgcgtggagtggctccaca

SEQ ID NO: 427657 - DNA, 27 bp, Artificial Sequence
  Description of Artificial Sequence: Synthetic oligonucleotide
cacgtgcgtggagtggctccacagata

SEQ ID NO: 427658 - DNA, 27 bp, Artificial Sequence
  Description of Artificial Sequence: Synthetic oligonucleotide
acgtgcgtggagtggctccacagatac

SEQ ID NO: 427659 - DNA, 26 bp, Artificial Sequence
  Description of Artificial Sequence: Synthetic oligonucleotide
cgtgcgtggagtggctccacagatac

SEQ ID NO: 427660 - DNA, 27 bp, Artificial Sequence
  Description of Artificial Sequence: Synthetic oligonucleotide
gtgcgtggagtggctccacagatacct

SEQ ID NO: 427661 - DNA, 27 bp, Artificial Sequence
  Description of Artificial Sequence: Synthetic oligonucleotide
tgcgtggagtggctccacagatacctg

SEQ ID NO: 427662 - DNA, 26 bp, Artificial Sequence
  Description of Artificial Sequence: Synthetic oligonucleotide
gcgtggagtggctccacagatacctg

SEQ ID NO: 427663 - DNA, 27 bp, Artificial Sequence
  Description of Artificial Sequence: Synthetic oligonucleotide
cgtggagtggctccacagatacctgga

SEQ ID NO: 427664 - DNA, 27 bp, Artificial Sequence
  Description of Artificial Sequence: Synthetic oligonucleotide
gtggagtggctccacagatacctggag

SEQ ID NO: 427665 - DNA, 29 bp, Artificial Sequence
  Description of Artificial Sequence: Synthetic oligonucleotide
tggagtggctccacagatacctggagaac

SEQ ID NO: 427666 - DNA, 28 bp, Artificial Sequence
  Description of Artificial Sequence: Synthetic oligonucleotide
ggagtggctccacagatacctggagaac

SEQ ID NO: 427667 - DNA, 28 bp, Artificial Sequence
  Description of Artificial Sequence: Synthetic oligonucleotide
gagtggctccacagatacctggagaacg

SEQ ID NO: 427668 - DNA, 28 bp, Artificial Sequence
  Description of Artificial Sequence: Synthetic oligonucleotide
agtggctccacagatacctggagaacgg

SEQ ID NO: 427669 - DNA, 27 bp, Artificial Sequence
  Description of Artificial Sequence: Synthetic oligonucleotide
gtggctccacagatacctggagaacgg

SEQ ID NO: 427670 - DNA, 27 bp, Artificial Sequence
  Description of Artificial Sequence: Synthetic oligonucleotide
tggctccacagatacctggagaacggg

SEQ ID NO: 427671 - DNA, 27 bp, Artificial Sequence
  Description of Artificial Sequence: Synthetic oligonucleotide
ggctccacagatacctggagaacggga

SEQ ID NO: 427672 - DNA, 28 bp, Artificial Sequence
  Description of Artificial Sequence: Synthetic oligonucleotide
gctccacagatacctggagaacgggaag

SEQ ID NO: 427673 - DNA, 28 bp, Artificial Sequence
  Description of Artificial Sequence: Synthetic oligonucleotide
ctccacagatacctggagaacgggaagg

SEQ ID NO: 427674 - DNA, 29 bp, Artificial Sequence
  Description of Artificial Sequence: Synthetic oligonucleotide
tccacagatacctggagaacgggaaggag

SEQ ID NO: 427675 - DNA, 28 bp, Artificial Sequence
  Description of Artificial Sequence: Synthetic oligonucleotide
ccacagatacctggagaacgggaaggag

SEQ ID NO: 427676 - DNA, 30 bp, Artificial Sequence; identical to SEQ ID NO: 77750
  Description of Artificial Sequence: Synthetic oligonucleotide

SEQ ID NO: 427677 - DNA, 30 bp, Artificial Sequence; identical to SEQ ID NO: 77751
  Description of Artificial Sequence: Synthetic oligonucleotide

SEQ ID NO: 427678 - DNA, 29 bp, Artificial Sequence
  Description of Artificial Sequence: Synthetic oligonucleotide
cagatacctggagaacgggaaggagatgc

SEQ ID NO: 427679 - DNA, 30 bp, Artificial Sequence; identical to SEQ ID NO: 7541
  Description of Artificial Sequence: Synthetic oligonucleotide

SEQ ID NO: 427680 - DNA, 29 bp, Artificial Sequence
  Description of Artificial Sequence: Synthetic oligonucleotide
gatacctggagaacgggaaggagatgctg

SEQ ID NO: 427681 - DNA, 29 bp, Artificial Sequence
  Description of Artificial Sequence: Synthetic oligonucleotide
atacctggagaacgggaaggagatgctgc

SEQ ID NO: 427682 - DNA, 28 bp, Artificial Sequence
  Description of Artificial Sequence: Synthetic oligonucleotide
tacctggagaacgggaaggagatgctgc

SEQ ID NO: 427683 - DNA, 27 bp, Artificial Sequence
  Description of Artificial Sequence: Synthetic oligonucleotide
acctggagaacgggaaggagatgctgc

SEQ ID NO: 427684 - DNA, 27 bp, Artificial Sequence
  Description of Artificial Sequence: Synthetic oligonucleotide
cctggagaacgggaaggagatgctgca

SEQ ID NO: 427685 - DNA, 27 bp, Artificial Sequence
  Description of Artificial Sequence: Synthetic oligonucleotide
ctggagaacgggaaggagatgctgcag

SEQ ID NO: 427686 - DNA, 27 bp, Artificial Sequence
  Description of Artificial Sequence: Synthetic oligonucleotide
tggagaacgggaaggagatgctgcagc

SEQ ID NO: 427687 - DNA, 26 bp, Artificial Sequence
  Description of Artificial Sequence: Synthetic oligonucleotide
ggagaacgggaaggagatgctgcagc

SEQ ID NO: 427688 - DNA, 26 bp, Artificial Sequence
  Description of Artificial Sequence: Synthetic oligonucleotide
gagaacgggaaggagatgctgcagcg

SEQ ID NO: 427689 - DNA, 26 bp, Artificial Sequence
  Description of Artificial Sequence: Synthetic oligonucleotide
agaacgggaaggagatgctgcagcgc

SEQ ID NO: 427690 - DNA, 25 bp, Artificial Sequence
  Description of Artificial Sequence: Synthetic oligonucleotide
gaacgggaaggagatgctgcagcgc

SEQ ID NO: 427691 - DNA, 25 bp, Artificial Sequence
  Description of Artificial Sequence: Synthetic oligonucleotide
aacgggaaggagatgctgcagcgcg

SEQ ID NO: 427692 - DNA, 24 bp, Artificial Sequence
  Description of Artificial Sequence: Synthetic oligonucleotide
acgggaaggagatgctgcagcgcg

SEQ ID NO: 427693 - DNA, 23 bp, Artificial Sequence
  Description of Artificial Sequence: Synthetic oligonucleotide
cgggaaggagatgctgcagcgcg

SEQ ID NO: 427694 - DNA, 23 bp, Artificial Sequence
  Description of Artificial Sequence: Synthetic oligonucleotide
gggaaggagatgctgcagcgcgc

SEQ ID NO: 427695 - DNA, 23 bp, Artificial Sequence
  Description of Artificial Sequence: Synthetic oligonucleotide
ggaaggagatgctgcagcgcgcg

SEQ ID NO: 427696 - DNA, 24 bp, Artificial Sequence
  Description of Artificial Sequence: Synthetic oligonucleotide
gaaggagatgctgcagcgcgcgga

SEQ ID NO: 427697 - DNA, 24 bp, Artificial Sequence
  Description of Artificial Sequence: Synthetic oligonucleotide
aaggagatgctgcagcgcgcggac

SEQ ID NO: 427698 - DNA, 23 bp, Artificial Sequence
  Description of Artificial Sequence: Synthetic oligonucleotide
aggagatgctgcagcgcgcggac

SEQ ID NO: 427699 - DNA, 22 bp, Artificial Sequence
  Description of Artificial Sequence: Synthetic oligonucleotide
ggagatgctgcagcgcgcggac

SEQ ID NO: 427700 - DNA, 22 bp, Artificial Sequence
  Description of Artificial Sequence: Synthetic oligonucleotide
gagatgctgcagcgcgcggacc

SEQ ID NO: 427701 - DNA, 22 bp, Artificial Sequence
  Description of Artificial Sequence: Synthetic oligonucleotide
agatgctgcagcgcgcggaccc

SEQ ID NO: 427702 - DNA, 21 bp, Artificial Sequence
  Description of Artificial Sequence: Synthetic oligonucleotide
gatgctgcagcgcgcggaccc

SEQ ID NO: 427703 - DNA, 21 bp, Artificial Sequence
  Description of Artificial Sequence: Synthetic oligonucleotide
atgctgcagcgcgcggacccc

SEQ ID NO: 427704 - DNA, 20 bp, Artificial Sequence
  Description of Artificial Sequence: Synthetic oligonucleotide
tgctgcagcgcgcggacccc

SEQ ID NO: 427705 - DNA, 20 bp, Artificial Sequence
  Description of Artificial Sequence: Synthetic oligonucleotide
tgcagcgcgcggacccccct

SEQ ID NO: 427706 - DNA, 20 bp, Artificial Sequence
  Description of Artificial Sequence: Synthetic oligonucleotide
gcagcgcgcggacccccctt

SEQ ID NO: 427707 - DNA, 20 bp, Artificial Sequence
  Description of Artificial Sequence: Synthetic oligonucleotide
cagcgcgcggacccccccaa

SEQ ID NO: 427708 - DNA, 21 bp, Artificial Sequence
  Description of Artificial Sequence: Synthetic oligonucleotide
agcgcgcggacccccccaaga

SEQ ID NO: 427709 - DNA, 20 bp, Artificial Sequence
  Description of Artificial Sequence: Synthetic oligonucleotide
gcgcgcggacccccccaaga

SEQ ID NO: 427710 - DNA, 21 bp, Artificial Sequence
  Description of Artificial Sequence: Synthetic oligonucleotide
cgcgcggacccccccaagaca

SEQ ID NO: 427711 - DNA, 22 bp, Artificial Sequence
  Description of Artificial Sequence: Synthetic oligonucleotide
gcgcggacccccccaagacaca

SEQ ID NO: 427712 - DNA, 22 bp, Artificial Sequence
  Description of Artificial Sequence: Synthetic oligonucleotide
cgcggacccccccaagacacac

SEQ ID NO: 427713 - DNA, 23 bp, Artificial Sequence
  Description of Artificial Sequence: Synthetic oligonucleotide
gcggacccccccaagacacacgt

SEQ ID NO: 427714 - DNA, 24 bp, Artificial Sequence
  Description of Artificial Sequence: Synthetic oligonucleotide
cggacccccccaagacacacgtga

SEQ ID NO: 427715 - DNA, 24 bp, Artificial Sequence
  Description of Artificial Sequence: Synthetic oligonucleotide
ggacccccccaagacacacgtgac

SEQ ID NO: 427716 - DNA, 24 bp, Artificial Sequence
  Description of Artificial Sequence: Synthetic oligonucleotide
gacccccccaagacacacgtgacc

SEQ ID NO: 427717 - DNA, 25 bp, Artificial Sequence
  Description of Artificial Sequence: Synthetic oligonucleotide
acccccccaagacacacgtgaccca

SEQ ID NO: 427718 - DNA, 24 bp, Artificial Sequence
  Description of Artificial Sequence: Synthetic oligonucleotide
cccccccaagacacacgtgaccca

SEQ ID NO: 427719 - DNA, 24 bp, Artificial Sequence
  Description of Artificial Sequence: Synthetic oligonucleotide
ccccccaagacacacgtgacccac

SEQ ID NO: 427720 - DNA, 25 bp, Artificial Sequence
  Description of Artificial Sequence: Synthetic oligonucleotide
cccccaagacacacgtgacccacca

SEQ ID NO: 427721 - DNA, 25 bp, Artificial Sequence
  Description of Artificial Sequence: Synthetic oligonucleotide
ccccaagacacacgtgacccaccac

SEQ ID NO: 427722 - DNA, 25 bp, Artificial Sequence
  Description of Artificial Sequence: Synthetic oligonucleotide
cccaagacacacgtgacccaccacc

SEQ ID NO: 427723 - DNA, 26 bp, Artificial Sequence
  Description of Artificial Sequence: Synthetic oligonucleotide
ccaagacacacgtgacccaccaccct

SEQ ID NO: 427724 - DNA, 27 bp, Artificial Sequence
  Description of Artificial Sequence: Synthetic oligonucleotide
caagacacacgtgacccaccaccctgt

SEQ ID NO: 427725 - DNA, 27 bp, Artificial Sequence
  Description of Artificial Sequence: Synthetic oligonucleotide
aagacacacgtgacccaccaccctgtc

SEQ ID NO: 427726 - DNA, 27 bp, Artificial Sequence
  Description of Artificial Sequence: Synthetic oligonucleotide
agacacacgtgacccaccaccctgtct

SEQ ID NO: 427727 - DNA, 27 bp, Artificial Sequence
  Description of Artificial Sequence: Synthetic oligonucleotide
gacacacgtgacccaccaccctgtctt

SEQ ID NO: 427728 - DNA, 28 bp, Artificial Sequence
  Description of Artificial Sequence: Synthetic oligonucleotide
acacacgtgacccaccaccctgtctttg

SEQ ID NO: 427729 - DNA, 27 bp, Artificial Sequence
  Description of Artificial Sequence: Synthetic oligonucleotide
cacacgtgacccaccaccctgtctttg

SEQ ID NO: 427730 - DNA, 28 bp, Artificial Sequence
  Description of Artificial Sequence: Synthetic oligonucleotide
acacgtgacccaccaccctgtctttgac

SEQ ID NO: 427731 - DNA, 27 bp, Artificial Sequence
  Description of Artificial Sequence: Synthetic oligonucleotide
cacgtgacccaccaccctgtctttgac

SEQ ID NO: 427732 - DNA, 30 bp, Artificial Sequence; identical to SEQ ID NO: 77782
  Description of Artificial Sequence: Synthetic oligonucleotide

SEQ ID NO: 427733 - DNA, 29 bp, Artificial Sequence
  Description of Artificial Sequence: Synthetic oligonucleotide
cgtgacccaccaccctgtctttgactatg

SEQ ID NO: 427734 - DNA, 30 bp, Artificial Sequence; identical to SEQ ID NO: 77784
  Description of Artificial Sequence: Synthetic oligonucleotide

SEQ ID NO: 427735 - DNA, 30 bp, Artificial Sequence; identical to SEQ ID NO: 77785
  Description of Artificial Sequence: Synthetic oligonucleotide

SEQ ID NO: 427736 - DNA, 29 bp, Artificial Sequence
  Description of Artificial Sequence: Synthetic oligonucleotide
gacccaccaccctgtctttgactatgagg

SEQ ID NO: 427737 - DNA, 29 bp, Artificial Sequence
  Description of Artificial Sequence: Synthetic oligonucleotide
acccaccaccctgtctttgactatgaggc

SEQ ID NO: 427738 - DNA, 28 bp, Artificial Sequence
  Description of Artificial Sequence: Synthetic oligonucleotide
cccaccaccctgtctttgactatgaggc

SEQ ID NO: 427739 - DNA, 28 bp, Artificial Sequence
  Description of Artificial Sequence: Synthetic oligonucleotide
ccaccaccctgtctttgactatgaggcc

SEQ ID NO: 427740 - DNA, 29 bp, Artificial Sequence
  Description of Artificial Sequence: Synthetic oligonucleotide
caccaccctgtctttgactatgaggccac

SEQ ID NO: 427741 - DNA, 29 bp, Artificial Sequence
  Description of Artificial Sequence: Synthetic oligonucleotide
accaccctgtctttgactatgaggccacc

SEQ ID NO: 427742 - DNA, 28 bp, Artificial Sequence
  Description of Artificial Sequence: Synthetic oligonucleotide
ccaccctgtctttgactatgaggccacc

SEQ ID NO: 427743 - DNA, 28 bp, Artificial Sequence
  Description of Artificial Sequence: Synthetic oligonucleotide
caccctgtctttgactatgaggccaccc

SEQ ID NO: 427744 - DNA, 29 bp, Artificial Sequence
  Description of Artificial Sequence: Synthetic oligonucleotide
accctgtctttgactatgaggccaccctg

SEQ ID NO: 427745 - DNA, 28 bp, Artificial Sequence
  Description of Artificial Sequence: Synthetic oligonucleotide
ccctgtctttgactatgaggccaccctg

SEQ ID NO: 427746 - DNA, 29 bp, Artificial Sequence
  Description of Artificial Sequence: Synthetic oligonucleotide
cctgtctttgactatgaggccaccctgag

SEQ ID NO: 427747 - DNA, 29 bp, Artificial Sequence
  Description of Artificial Sequence: Synthetic oligonucleotide
ctgtctttgactatgaggccaccctgagg

SEQ ID NO: 427748 - DNA, 30 bp, Artificial Sequence; identical to SEQ ID NO: 77798
  Description of Artificial Sequence: Synthetic oligonucleotide

SEQ ID NO: 427749 - DNA, 29 bp, Artificial Sequence
  Description of Artificial Sequence: Synthetic oligonucleotide
gtctttgactatgaggccaccctgaggtg

SEQ ID NO: 427750 - DNA, 29 bp, Artificial Sequence
  Description of Artificial Sequence: Synthetic oligonucleotide
tctttgactatgaggccaccctgaggtgc

SEQ ID NO: 427751 - DNA, 28 bp, Artificial Sequence
  Description of Artificial Sequence: Synthetic oligonucleotide
ctttgactatgaggccaccctgaggtgc

SEQ ID NO: 427752 - DNA, 29 bp, Artificial Sequence
  Description of Artificial Sequence: Synthetic oligonucleotide
tttgactatgaggccaccctgaggtgctg

SEQ ID NO: 427753 - DNA, 28 bp, Artificial Sequence
  Description of Artificial Sequence: Synthetic oligonucleotide
ttgactatgaggccaccctgaggtgctg

SEQ ID NO: 427754 - DNA, 27 bp, Artificial Sequence
  Description of Artificial Sequence: Synthetic oligonucleotide
tgactatgaggccaccctgaggtgctg

SEQ ID NO: 427755 - DNA, 26 bp, Artificial Sequence
  Description of Artificial Sequence: Synthetic oligonucleotide
gactatgaggccaccctgaggtgctg

SEQ ID NO: 427756 - DNA, 26 bp, Artificial Sequence
  Description of Artificial Sequence: Synthetic oligonucleotide
actatgaggccaccctgaggtgctgg

SEQ ID NO: 427757 - DNA, 25 bp, Artificial Sequence
  Description of Artificial Sequence: Synthetic oligonucleotide
ctatgaggccaccctgaggtgctgg

SEQ ID NO: 427758 - DNA, 25 bp, Artificial Sequence
  Description of Artificial Sequence: Synthetic oligonucleotide
tatgaggccaccctgaggtgctggg

SEQ ID NO: 427759 - DNA, 27 bp, Artificial Sequence
  Description of Artificial Sequence: Synthetic oligonucleotide
cctgggcttctaccctgcggagatcat

SEQ ID NO: 427760 - DNA, 28 bp, Artificial Sequence
  Description of Artificial Sequence: Synthetic oligonucleotide
ctgggcttctaccctgcggagatcatac

SEQ ID NO: 427761 - DNA, 29 bp, Artificial Sequence
  Description of Artificial Sequence: Synthetic oligonucleotide
tgggcttctaccctgcggagatcatactg

SEQ ID NO: 427762 - DNA, 28 bp, Artificial Sequence
  Description of Artificial Sequence: Synthetic oligonucleotide
gggcttctaccctgcggagatcatactg

SEQ ID NO: 427763 - DNA, 29 bp, Artificial Sequence
  Description of Artificial Sequence: Synthetic oligonucleotide
ggcttctaccctgcggagatcatactgac

SEQ ID NO: 427764 - DNA, 29 bp, Artificial Sequence
  Description of Artificial Sequence: Synthetic oligonucleotide
gcttctaccctgcggagatcatactgacc

SEQ ID NO: 427765 - DNA, 30 bp, Artificial Sequence; identical to SEQ ID NO: 77815
  Description of Artificial Sequence: Synthetic oligonucleotide

SEQ ID NO: 427766 - DNA, 30 bp, Artificial Sequence; identical to SEQ ID NO: 77816
  Description of Artificial Sequence: Synthetic oligonucleotide

SEQ ID NO: 427767 - DNA, 29 bp, Artificial Sequence
  Description of Artificial Sequence: Synthetic oligonucleotide
tctaccctgcggagatcatactgacctgg

SEQ ID NO: 427768 - DNA, 28 bp, Artificial Sequence
  Description of Artificial Sequence: Synthetic oligonucleotide
ctaccctgcggagatcatactgacctgg

SEQ ID NO: 427769 - DNA, 28 bp, Artificial Sequence
  Description of Artificial Sequence: Synthetic oligonucleotide
taccctgcggagatcatactgacctggc

SEQ ID NO: 427770 - DNA, 27 bp, Artificial Sequence
  Description of Artificial Sequence: Synthetic oligonucleotide
accctgcggagatcatactgacctggc

SEQ ID NO: 427771 - DNA, 27 bp, Artificial Sequence
  Description of Artificial Sequence: Synthetic oligonucleotide
ccctgcggagatcatactgacctggca

SEQ ID NO: 427772 - DNA, 27 bp, Artificial Sequence
  Description of Artificial Sequence: Synthetic oligonucleotide
cctgcggagatcatactgacctggcag

SEQ ID NO: 427773 - DNA, 27 bp, Artificial Sequence
  Description of Artificial Sequence: Synthetic oligonucleotide
ctgcggagatcatactgacctggcagc

SEQ ID NO: 427774 - DNA, 27 bp, Artificial Sequence
  Description of Artificial Sequence: Synthetic oligonucleotide
tgcggagatcatactgacctggcagcg

SEQ ID NO: 427775 - DNA, 26 bp, Artificial Sequence
  Description of Artificial Sequence: Synthetic oligonucleotide
gcggagatcatactgacctggcagcg

SEQ ID NO: 427776 - DNA, 26 bp, Artificial Sequence
  Description of Artificial Sequence: Synthetic oligonucleotide
cggagatcatactgacctggcagcgg

SEQ ID NO: 427777 - DNA, 27 bp, Artificial Sequence
  Description of Artificial Sequence: Synthetic oligonucleotide
ggagatcatactgacctggcagcggga

SEQ ID NO: 427778 - DNA, 28 bp, Artificial Sequence
  Description of Artificial Sequence: Synthetic oligonucleotide
gagatcatactgacctggcagcgggatg

SEQ ID NO: 427779 - DNA, 28 bp, Artificial Sequence
  Description of Artificial Sequence: Synthetic oligonucleotide
agatcatactgacctggcagcgggatgg

SEQ ID NO: 427780 - DNA, 27 bp, Artificial Sequence
  Description of Artificial Sequence: Synthetic oligonucleotide
gatcatactgacctggcagcgggatgg

SEQ ID NO: 427781 - DNA, 27 bp, Artificial Sequence
  Description of Artificial Sequence: Synthetic oligonucleotide
atcatactgacctggcagcgggatggg

SEQ ID NO: 427782 - DNA, 26 bp, Artificial Sequence
  Description of Artificial Sequence: Synthetic oligonucleotide
tcatactgacctggcagcgggatggg

SEQ ID NO: 427783 - DNA, 25 bp, Artificial Sequence
  Description of Artificial Sequence: Synthetic oligonucleotide
catactgacctggcagcgggatggg

SEQ ID NO: 427784 - DNA, 26 bp, Artificial Sequence
  Description of Artificial Sequence: Synthetic oligonucleotide
atactgacctggcagcgggatgggga

SEQ ID NO: 427785 - DNA, 25 bp, Artificial Sequence
  Description of Artificial Sequence: Synthetic oligonucleotide
tactgacctggcagcgggatgggga

SEQ ID NO: 427786 - DNA, 24 bp, Artificial Sequence
  Description of Artificial Sequence: Synthetic oligonucleotide
gatggggaggaccagacccaggac

SEQ ID NO: 427787 - DNA, 25 bp, Artificial Sequence
  Description of Artificial Sequence: Synthetic oligonucleotide
atggggaggaccagacccaggacgt

SEQ ID NO: 427788 - DNA, 24 bp, Artificial Sequence
  Description of Artificial Sequence: Synthetic oligonucleotide
tggggaggaccagacccaggacgt

SEQ ID NO: 427789 - DNA, 23 bp, Artificial Sequence
  Description of Artificial Sequence: Synthetic oligonucleotide
ggggaggaccagacccaggacgt

SEQ ID NO: 427790 - DNA, 23 bp, Artificial Sequence
  Description of Artificial Sequence: Synthetic oligonucleotide
gggaggaccagacccaggacgtg

SEQ ID NO: 427791 - DNA, 24 bp, Artificial Sequence
  Description of Artificial Sequence: Synthetic oligonucleotide
ggaggaccagacccaggacgtgga

SEQ ID NO: 427792 - DNA, 24 bp, Artificial Sequence
  Description of Artificial Sequence: Synthetic oligonucleotide
gaggaccagacccaggacgtggag

SEQ ID NO: 427793 - DNA, 25 bp, Artificial Sequence
  Description of Artificial Sequence: Synthetic oligonucleotide
aggaccagacccaggacgtggagct

SEQ ID NO: 427794 - DNA, 24 bp, Artificial Sequence
  Description of Artificial Sequence: Synthetic oligonucleotide
ggaccagacccaggacgtggagct

SEQ ID NO: 427795 - DNA, 24 bp, Artificial Sequence
  Description of Artificial Sequence: Synthetic oligonucleotide
gaccagacccaggacgtggagctc

SEQ ID NO: 427796 - DNA, 25 bp, Artificial Sequence
  Description of Artificial Sequence: Synthetic oligonucleotide
accagacccaggacgtggagctcgt

SEQ ID NO: 427797 - DNA, 24 bp, Artificial Sequence
  Description of Artificial Sequence: Synthetic oligonucleotide
ccagacccaggacgtggagctcgt

SEQ ID NO: 427798 - DNA, 24 bp, Artificial Sequence
  Description of Artificial Sequence: Synthetic oligonucleotide
cagacccaggacgtggagctcgtg

SEQ ID NO: 427799 - DNA, 25 bp, Artificial Sequence
  Description of Artificial Sequence: Synthetic oligonucleotide
agacccaggacgtggagctcgtgga

SEQ ID NO: 427800 - DNA, 24 bp, Artificial Sequence
  Description of Artificial Sequence: Synthetic oligonucleotide
gacccaggacgtggagctcgtgga

SEQ ID NO: 427801 - DNA, 25 bp, Artificial Sequence
  Description of Artificial Sequence: Synthetic oligonucleotide
acccaggacgtggagctcgtggaga

SEQ ID NO: 427802 - DNA, 24 bp, Artificial Sequence
  Description of Artificial Sequence: Synthetic oligonucleotide
cccaggacgtggagctcgtggaga

SEQ ID NO: 427803 - DNA, 24 bp, Artificial Sequence
  Description of Artificial Sequence: Synthetic oligonucleotide
ccaggacgtggagctcgtggagac

SEQ ID NO: 427804 - DNA, 25 bp, Artificial Sequence
  Description of Artificial Sequence: Synthetic oligonucleotide
caggacgtggagctcgtggagacca

SEQ ID NO: 427805 - DNA, 25 bp, Artificial Sequence
  Description of Artificial Sequence: Synthetic oligonucleotide
aggacgtggagctcgtggagaccag

SEQ ID NO: 427806 - DNA, 24 bp, Artificial Sequence
  Description of Artificial Sequence: Synthetic oligonucleotide
ggacgtggagctcgtggagaccag

SEQ ID NO: 427807 - DNA, 24 bp, Artificial Sequence
  Description of Artificial Sequence: Synthetic oligonucleotide
gacgtggagctcgtggagaccagg

SEQ ID NO: 427808 - DNA, 24 bp, Artificial Sequence
  Description of Artificial Sequence: Synthetic oligonucleotide
acgtggagctcgtggagaccaggc

SEQ ID NO: 427809 - DNA, 23 bp, Artificial Sequence
  Description of Artificial Sequence: Synthetic oligonucleotide
cgtggagctcgtggagaccaggc

SEQ ID NO: 427810 - DNA, 24 bp, Artificial Sequence
  Description of Artificial Sequence: Synthetic oligonucleotide
gtggagctcgtggagaccaggcct

SEQ ID NO: 427811 - DNA, 24 bp, Artificial Sequence
  Description of Artificial Sequence: Synthetic oligonucleotide
tggagctcgtggagaccaggcctg

SEQ ID NO: 427812 - DNA, 24 bp, Artificial Sequence
  Description of Artificial Sequence: Synthetic oligonucleotide
catgtgcagcatgaggggctgccg

SEQ ID NO: 427813 - DNA, 25 bp, Artificial Sequence
  Description of Artificial Sequence: Synthetic oligonucleotide
atgtgcagcatgaggggctgccgga

SEQ ID NO: 427814 - DNA, 24 bp, Artificial Sequence
  Description of Artificial Sequence: Synthetic oligonucleotide
tgtgcagcatgaggggctgccgga

SEQ ID NO: 427815 - DNA, 23 bp, Artificial Sequence
  Description of Artificial Sequence: Synthetic oligonucleotide
gtgcagcatgaggggctgccgga

SEQ ID NO: 427816 - DNA, 23 bp, Artificial Sequence
  Description of Artificial Sequence: Synthetic oligonucleotide
tgcagcatgaggggctgccggag

SEQ ID NO: 427817 - DNA, 22 bp, Artificial Sequence
  Description of Artificial Sequence: Synthetic oligonucleotide
gcagcatgaggggctgccggag

SEQ ID NO: 427818 - DNA, 22 bp, Artificial Sequence
  Description of Artificial Sequence: Synthetic oligonucleotide
cagcatgaggggctgccggagc

SEQ ID NO: 427819 - DNA, 22 bp, Artificial Sequence
  Description of Artificial Sequence: Synthetic oligonucleotide
agcatgaggggctgccggagcc

SEQ ID NO: 427820 - DNA, 21 bp, Artificial Sequence
  Description of Artificial Sequence: Synthetic oligonucleotide
gcatgaggggctgccggagcc

SEQ ID NO: 427821 - DNA, 21 bp, Artificial Sequence
  Description of Artificial Sequence: Synthetic oligonucleotide
catgaggggctgccggagccc

SEQ ID NO: 427822 - DNA, 22 bp, Artificial Sequence
  Description of Artificial Sequence: Synthetic oligonucleotide
atgaggggctgccggagcccct

SEQ ID NO: 427823 - DNA, 21 bp, Artificial Sequence
  Description of Artificial Sequence: Synthetic oligonucleotide
tgaggggctgccggagcccct

SEQ ID NO: 427824 - DNA, 22 bp, Artificial Sequence
  Description of Artificial Sequence: Synthetic oligonucleotide
aggggctgccggagcccctcat

SEQ ID NO: 427825 - DNA, 21 bp, Artificial Sequence
  Description of Artificial Sequence: Synthetic oligonucleotide
ggggctgccggagcccctcat

SEQ ID NO: 427826 - DNA, 21 bp, Artificial Sequence
  Description of Artificial Sequence: Synthetic oligonucleotide
gggctgccggagcccctcatg

SEQ ID NO: 427827 - DNA, 22 bp, Artificial Sequence
  Description of Artificial Sequence: Synthetic oligonucleotide
ggctgccggagcccctcatgct

SEQ ID NO: 427828 - DNA, 23 bp, Artificial Sequence
  Description of Artificial Sequence: Synthetic oligonucleotide
gctgccggagcccctcatgctga

SEQ ID NO: 427829 - DNA, 25 bp, Artificial Sequence
  Description of Artificial Sequence: Synthetic oligonucleotide
ctgccggagcccctcatgctgagat

SEQ ID NO: 427830 - DNA, 25 bp, Artificial Sequence
  Description of Artificial Sequence: Synthetic oligonucleotide
tgccggagcccctcatgctgagatg

SEQ ID NO: 427831 - DNA, 24 bp, Artificial Sequence
  Description of Artificial Sequence: Synthetic oligonucleotide
gccggagcccctcatgctgagatg

SEQ ID NO: 427832 - DNA, 26 bp, Artificial Sequence
  Description of Artificial Sequence: Synthetic oligonucleotide
ccggagcccctcatgctgagatggaa

SEQ ID NO: 427833 - DNA, 26 bp, Artificial Sequence
  Description of Artificial Sequence: Synthetic oligonucleotide
cggagcccctcatgctgagatggaag

SEQ ID NO: 427834 - DNA, 27 bp, Artificial Sequence
  Description of Artificial Sequence: Synthetic oligonucleotide
ggagcccctcatgctgagatggaagca

SEQ ID NO: 427835 - DNA, 27 bp, Artificial Sequence
  Description of Artificial Sequence: Synthetic oligonucleotide
gagcccctcatgctgagatggaagcag

SEQ ID NO: 427836 - DNA, 28 bp, Artificial Sequence
  Description of Artificial Sequence: Synthetic oligonucleotide
agcccctcatgctgagatggaagcagtc

SEQ ID NO: 427837 - DNA, 27 bp, Artificial Sequence
  Description of Artificial Sequence: Synthetic oligonucleotide
gcccctcatgctgagatggaagcagtc

SEQ ID NO: 427838 - DNA, 29 bp, Artificial Sequence
  Description of Artificial Sequence: Synthetic oligonucleotide
cccctcatgctgagatggaagcagtcttc

SEQ ID NO: 427839 - DNA, 29 bp, Artificial Sequence
  Description of Artificial Sequence: Synthetic oligonucleotide
ccctcatgctgagatggaagcagtcttcc

SEQ ID NO: 427840 - DNA, 29 bp, Artificial Sequence
  Description of Artificial Sequence: Synthetic oligonucleotide
cctcatgctgagatggaagcagtcttccc

SEQ ID NO: 427841 - DNA, 30 bp, Artificial Sequence; identical to SEQ ID NO: 77885
  Description of Artificial Sequence: Synthetic oligonucleotide

SEQ ID NO: 427842 - DNA, 30 bp, Artificial Sequence; identical to SEQ ID NO: 77886
  Description of Artificial Sequence: Synthetic oligonucleotide

SEQ ID NO: 427843 - DNA, 29 bp, Artificial Sequence
  Description of Artificial Sequence: Synthetic oligonucleotide
catgctgagatggaagcagtcttccctgc

SEQ ID NO: 427844 - DNA, 29 bp, Artificial Sequence
  Description of Artificial Sequence: Synthetic oligonucleotide
atgctgagatggaagcagtcttccctgcc

SEQ ID NO: 427845 - DNA, 28 bp, Artificial Sequence
  Description of Artificial Sequence: Synthetic oligonucleotide
tgctgagatggaagcagtcttccctgcc

SEQ ID NO: 427846 - DNA, 27 bp, Artificial Sequence
  Description of Artificial Sequence: Synthetic oligonucleotide
gctgagatggaagcagtcttccctgcc

SEQ ID NO: 427847 - DNA, 27 bp, Artificial Sequence
  Description of Artificial Sequence: Synthetic oligonucleotide
ctgagatggaagcagtcttccctgccc

SEQ ID NO: 427848 - DNA, 28 bp, Artificial Sequence
  Description of Artificial Sequence: Synthetic oligonucleotide
tgagatggaagcagtcttccctgcccac

SEQ ID NO: 427849 - DNA, 27 bp, Artificial Sequence
  Description of Artificial Sequence: Synthetic oligonucleotide
gagatggaagcagtcttccctgcccac

SEQ ID NO: 427850 - DNA, 27 bp, Artificial Sequence
  Description of Artificial Sequence: Synthetic oligonucleotide
agatggaagcagtcttccctgcccacc

SEQ ID NO: 427851 - DNA, 27 bp, Artificial Sequence
  Description of Artificial Sequence: Synthetic oligonucleotide
gatggaagcagtcttccctgcccacca

SEQ ID NO: 427852 - DNA, 28 bp, Artificial Sequence
  Description of Artificial Sequence: Synthetic oligonucleotide
atggaagcagtcttccctgcccaccatc

SEQ ID NO: 427853 - DNA, 27 bp, Artificial Sequence
  Description of Artificial Sequence: Synthetic oligonucleotide
tggaagcagtcttccctgcccaccatc

SEQ ID NO: 427854 - DNA, 26 bp, Artificial Sequence
  Description of Artificial Sequence: Synthetic oligonucleotide
ggaagcagtcttccctgcccaccatc

SEQ ID NO: 427855 - DNA, 26 bp, Artificial Sequence
  Description of Artificial Sequence: Synthetic oligonucleotide
gaagcagtcttccctgcccaccatcc

SEQ ID NO: 427856 - DNA, 26 bp, Artificial Sequence
  Description of Artificial Sequence: Synthetic oligonucleotide
aagcagtcttccctgcccaccatccc

SEQ ID NO: 427857 - DNA, 25 bp, Artificial Sequence
  Description of Artificial Sequence: Synthetic oligonucleotide
agcagtcttccctgcccaccatccc

SEQ ID NO: 427858 - DNA, 24 bp, Artificial Sequence
  Description of Artificial Sequence: Synthetic oligonucleotide
gcagtcttccctgcccaccatccc

SEQ ID NO: 427859 - DNA, 26 bp, Artificial Sequence
  Description of Artificial Sequence: Synthetic oligonucleotide
cagtcttccctgcccaccatccccat

SEQ ID NO: 427860 - DNA, 27 bp, Artificial Sequence
  Description of Artificial Sequence: Synthetic oligonucleotide
agtcttccctgcccaccatccccatca

SEQ ID NO: 427861 - DNA, 27 bp, Artificial Sequence
  Description of Artificial Sequence: Synthetic oligonucleotide
gtcttccctgcccaccatccccatcat

SEQ ID NO: 427862 - DNA, 27 bp, Artificial Sequence
  Description of Artificial Sequence: Synthetic oligonucleotide
tcttccctgcccaccatccccatcatg

SEQ ID NO: 427863 - DNA, 26 bp, Artificial Sequence
  Description of Artificial Sequence: Synthetic oligonucleotide
cttccctgcccaccatccccatcatg

SEQ ID NO: 427864 - DNA, 26 bp, Artificial Sequence
  Description of Artificial Sequence: Synthetic oligonucleotide
ttccctgcccaccatccccatcatgg

SEQ ID NO: 427865 - DNA, 25 bp, Artificial Sequence
  Description of Artificial Sequence: Synthetic oligonucleotide
tccctgcccaccatccccatcatgg

SEQ ID NO: 427866 - DNA, 24 bp, Artificial Sequence
  Description of Artificial Sequence: Synthetic oligonucleotide
ccctgcccaccatccccatcatgg

SEQ ID NO: 427867 - DNA, 27 bp, Artificial Sequence
  Description of Artificial Sequence: Synthetic oligonucleotide
cctgcccaccatccccatcatgggtat

SEQ ID NO: 427868 - DNA, 27 bp, Artificial Sequence
  Description of Artificial Sequence: Synthetic oligonucleotide
ctgcccaccatccccatcatgggtatc

SEQ ID NO: 427869 - DNA, 27 bp, Artificial Sequence
  Description of Artificial Sequence: Synthetic oligonucleotide
tgcccaccatccccatcatgggtatcg

SEQ ID NO: 427870 - DNA, 27 bp, Artificial Sequence
  Description of Artificial Sequence: Synthetic oligonucleotide
gcccaccatccccatcatgggtatcgt

SEQ ID NO: 427871 - DNA, 28 bp, Artificial Sequence
  Description of Artificial Sequence: Synthetic oligonucleotide
cccaccatccccatcatgggtatcgttg

SEQ ID NO: 427872 - DNA, 28 bp, Artificial Sequence
  Description of Artificial Sequence: Synthetic oligonucleotide
ccaccatccccatcatgggtatcgttgc

SEQ ID NO: 427873 - DNA, 29 bp, Artificial Sequence
  Description of Artificial Sequence: Synthetic oligonucleotide
caccatccccatcatgggtatcgttgctg

SEQ ID NO: 427874 - DNA, 29 bp, Artificial Sequence
  Description of Artificial Sequence: Synthetic oligonucleotide
accatccccatcatgggtatcgttgctgg

SEQ ID NO: 427875 - DNA, 28 bp, Artificial Sequence
  Description of Artificial Sequence: Synthetic oligonucleotide
ccatccccatcatgggtatcgttgctgg

SEQ ID NO: 427876 - DNA, 28 bp, Artificial Sequence
  Description of Artificial Sequence: Synthetic oligonucleotide
catccccatcatgggtatcgttgctggc

SEQ ID NO: 427877 - DNA, 28 bp, Artificial Sequence
  Description of Artificial Sequence: Synthetic oligonucleotide
atccccatcatgggtatcgttgctggcc

SEQ ID NO: 427878 - DNA, 27 bp, Artificial Sequence
  Description of Artificial Sequence: Synthetic oligonucleotide
tccccatcatgggtatcgttgctggcc

SEQ ID NO: 427879 - DNA, 27 bp, Artificial Sequence
  Description of Artificial Sequence: Synthetic oligonucleotide
ccccatcatgggtatcgttgctggcct

SEQ ID NO: 427880 - DNA, 27 bp, Artificial Sequence
  Description of Artificial Sequence: Synthetic oligonucleotide
cccatcatgggtatcgttgctggcctg

SEQ ID NO: 427881 - DNA, 27 bp, Artificial Sequence
  Description of Artificial Sequence: Synthetic oligonucleotide
ccatcatgggtatcgttgctggcctgg

SEQ ID NO: 427882 - DNA, 29 bp, Artificial Sequence
  Description of Artificial Sequence: Synthetic oligonucleotide
catcatgggtatcgttgctggcctggttg

SEQ ID NO: 427883 - DNA, 30 bp, Artificial Sequence; identical to SEQ ID NO: 77927
  Description of Artificial Sequence: Synthetic oligonucleotide

SEQ ID NO: 427884 - DNA, 29 bp, Artificial Sequence
  Description of Artificial Sequence: Synthetic oligonucleotide
tcatgggtatcgttgctggcctggttgtc

SEQ ID NO: 427885 - DNA, 28 bp, Artificial Sequence
  Description of Artificial Sequence: Synthetic oligonucleotide
catgggtatcgttgctggcctggttgtc

SEQ ID NO: 427886 - DNA, 28 bp, Artificial Sequence
  Description of Artificial Sequence: Synthetic oligonucleotide
atgggtatcgttgctggcctggttgtcc

SEQ ID NO: 427887 - DNA, 27 bp, Artificial Sequence
  Description of Artificial Sequence: Synthetic oligonucleotide
tgggtatcgttgctggcctggttgtcc

SEQ ID NO: 427888 - DNA, 27 bp, Artificial Sequence
  Description of Artificial Sequence: Synthetic oligonucleotide
gggtatcgttgctggcctggttgtcct

SEQ ID NO: 427889 - DNA, 28 bp, Artificial Sequence
  Description of Artificial Sequence: Synthetic oligonucleotide
ggtatcgttgctggcctggttgtccttg

SEQ ID NO: 427890 - DNA, 28 bp, Artificial Sequence
  Description of Artificial Sequence: Synthetic oligonucleotide
gtatcgttgctggcctggttgtccttgc

SEQ ID NO: 427891 - DNA, 29 bp, Artificial Sequence
  Description of Artificial Sequence: Synthetic oligonucleotide
tatcgttgctggcctggttgtccttgcag

SEQ ID NO: 427892 - DNA, 28 bp, Artificial Sequence
  Description of Artificial Sequence: Synthetic oligonucleotide
atcgttgctggcctggttgtccttgcag

SEQ ID NO: 427893 - DNA, 27 bp, Artificial Sequence
  Description of Artificial Sequence: Synthetic oligonucleotide
tcgttgctggcctggttgtccttgcag

SEQ ID NO: 427894 - DNA, 26 bp, Artificial Sequence
  Description of Artificial Sequence: Synthetic oligonucleotide
cgttgctggcctggttgtccttgcag

SEQ ID NO: 427895 - DNA, 27 bp, Artificial Sequence
  Description of Artificial Sequence: Synthetic oligonucleotide
gttgctggcctggttgtccttgcagct

SEQ ID NO: 427896 - DNA, 27 bp, Artificial Sequence
  Description of Artificial Sequence: Synthetic oligonucleotide
ttgctggcctggttgtccttgcagctg

SEQ ID NO: 427897 - DNA, 27 bp, Artificial Sequence
  Description of Artificial Sequence: Synthetic oligonucleotide
tgctggcctggttgtccttgcagctgt

SEQ ID NO: 427898 - DNA, 27 bp, Artificial Sequence
  Description of Artificial Sequence: Synthetic oligonucleotide
gctggcctggttgtccttgcagctgta

SEQ ID NO: 427899 - DNA, 27 bp, Artificial Sequence
  Description of Artificial Sequence: Synthetic oligonucleotide
ctggcctggttgtccttgcagctgtag

SEQ ID NO: 427900 - DNA, 28 bp, Artificial Sequence
  Description of Artificial Sequence: Synthetic oligonucleotide
tggcctggttgtccttgcagctgtagtc

SEQ ID NO: 427901 - DNA, 27 bp, Artificial Sequence
  Description of Artificial Sequence: Synthetic oligonucleotide
ggcctggttgtccttgcagctgtagtc

SEQ ID NO: 427902 - DNA, 28 bp, Artificial Sequence
  Description of Artificial Sequence: Synthetic oligonucleotide
gcctggttgtccttgcagctgtagtcac

SEQ ID NO: 427903 - DNA, 29 bp, Artificial Sequence
  Description of Artificial Sequence: Synthetic oligonucleotide
cctggttgtccttgcagctgtagtcactg

SEQ ID NO: 427904 - DNA, 29 bp, Artificial Sequence
  Description of Artificial Sequence: Synthetic oligonucleotide
ctggttgtccttgcagctgtagtcactgg

SEQ ID NO: 427905 - DNA, 30 bp, Artificial Sequence; identical to SEQ ID NO: 77949
  Description of Artificial Sequence: Synthetic oligonucleotide

SEQ ID NO: 427906 - DNA, 29 bp, Artificial Sequence
  Description of Artificial Sequence: Synthetic oligonucleotide
ggttgtccttgcagctgtagtcactggag

SEQ ID NO: 427907 - DNA, 29 bp, Artificial Sequence
  Description of Artificial Sequence: Synthetic oligonucleotide
gttgtccttgcagctgtagtcactggagc

SEQ ID NO: 427908 - DNA, 30 bp, Artificial Sequence; identical to SEQ ID NO: 77952
  Description of Artificial Sequence: Synthetic oligonucleotide

SEQ ID NO: 427909 - DNA, 29 bp, Artificial Sequence
  Description of Artificial Sequence: Synthetic oligonucleotide
tgtccttgcagctgtagtcactggagctg

SEQ ID NO: 427910 - DNA, 28 bp, Artificial Sequence
  Description of Artificial Sequence: Synthetic oligonucleotide
gtccttgcagctgtagtcactggagctg

SEQ ID NO: 427911 - DNA, 28 bp, Artificial Sequence
  Description of Artificial Sequence: Synthetic oligonucleotide
tccttgcagctgtagtcactggagctgc

SEQ ID NO: 427912 - DNA, 27 bp, Artificial Sequence
  Description of Artificial Sequence: Synthetic oligonucleotide
ccttgcagctgtagtcactggagctgc

SEQ ID NO: 427913 - DNA, 27 bp, Artificial Sequence
  Description of Artificial Sequence: Synthetic oligonucleotide
cttgcagctgtagtcactggagctgcg

SEQ ID NO: 427914 - DNA, 27 bp, Artificial Sequence
  Description of Artificial Sequence: Synthetic oligonucleotide
ttgcagctgtagtcactggagctgcgg

SEQ ID NO: 427915 - DNA, 27 bp, Artificial Sequence
  Description of Artificial Sequence: Synthetic oligonucleotide
tgcagctgtagtcactggagctgcggt

SEQ ID NO: 427916 - DNA, 26 bp, Artificial Sequence
  Description of Artificial Sequence: Synthetic oligonucleotide
gcagctgtagtcactggagctgcggt

SEQ ID NO: 427917 - DNA, 26 bp, Artificial Sequence
  Description of Artificial Sequence: Synthetic oligonucleotide
cagctgtagtcactggagctgcggtc

SEQ ID NO: 427918 - DNA, 26 bp, Artificial Sequence
  Description of Artificial Sequence: Synthetic oligonucleotide
agctgtagtcactggagctgcggtcg

SEQ ID NO: 427919 - DNA, 25 bp, Artificial Sequence
  Description of Artificial Sequence: Synthetic oligonucleotide
gctgtagtcactggagctgcggtcg

SEQ ID NO: 427920 - DNA, 26 bp, Artificial Sequence
  Description of Artificial Sequence: Synthetic oligonucleotide
ctgtagtcactggagctgcggtcgct

SEQ ID NO: 427921 - DNA, 26 bp, Artificial Sequence
  Description of Artificial Sequence: Synthetic oligonucleotide
tgtagtcactggagctgcggtcgctg

SEQ ID NO: 427922 - DNA, 25 bp, Artificial Sequence
  Description of Artificial Sequence: Synthetic oligonucleotide
gtagtcactggagctgcggtcgctg

SEQ ID NO: 427923 - DNA, 26 bp, Artificial Sequence
  Description of Artificial Sequence: Synthetic oligonucleotide
tagtcactggagctgcggtcgctgct

SEQ ID NO: 427924 - DNA, 25 bp, Artificial Sequence
  Description of Artificial Sequence: Synthetic oligonucleotide
agtcactggagctgcggtcgctgct

SEQ ID NO: 427925 - DNA, 24 bp, Artificial Sequence
  Description of Artificial Sequence: Synthetic oligonucleotide
gtcactggagctgcggtcgctgct

SEQ ID NO: 427926 - DNA, 25 bp, Artificial Sequence
  Description of Artificial Sequence: Synthetic oligonucleotide
tcactggagctgcggtcgctgctgt

SEQ ID NO: 427927 - DNA, 24 bp, Artificial Sequence
  Description of Artificial Sequence: Synthetic oligonucleotide
cactggagctgcggtcgctgctgt

SEQ ID NO: 427928 - DNA, 24 bp, Artificial Sequence
  Description of Artificial Sequence: Synthetic oligonucleotide
actggagctgcggtcgctgctgtg

SEQ ID NO: 427929 - DNA, 23 bp, Artificial Sequence
  Description of Artificial Sequence: Synthetic oligonucleotide
ctggagctgcggtcgctgctgtg

SEQ ID NO: 427930 - DNA, 24 bp, Artificial Sequence
  Description of Artificial Sequence: Synthetic oligonucleotide
tggagctgcggtcgctgctgtgct

SEQ ID NO: 427931 - DNA, 23 bp, Artificial Sequence
  Description of Artificial Sequence: Synthetic oligonucleotide
ggagctgcggtcgctgctgtgct

SEQ ID NO: 427932 - DNA, 24 bp, Artificial Sequence
  Description of Artificial Sequence: Synthetic oligonucleotide
gagctgcggtcgctgctgtgctgt

SEQ ID NO: 427933 - DNA, 24 bp, Artificial Sequence
  Description of Artificial Sequence: Synthetic oligonucleotide
agctgcggtcgctgctgtgctgtg

SEQ ID NO: 427934 - DNA, 23 bp, Artificial Sequence
  Description of Artificial Sequence: Synthetic oligonucleotide
gctgcggtcgctgctgtgctgtg

SEQ ID NO: 427935 - DNA, 24 bp, Artificial Sequence
  Description of Artificial Sequence: Synthetic oligonucleotide
ctgcggtcgctgctgtgctgtgga

SEQ ID NO: 427936 - DNA, 27 bp, Artificial Sequence
  Description of Artificial Sequence: Synthetic oligonucleotide
tgcggtcgctgctgtgctgtggagaaa

SEQ ID NO: 427937 - DNA, 26 bp, Artificial Sequence
  Description of Artificial Sequence: Synthetic oligonucleotide
gcggtcgctgctgtgctgtggagaaa

SEQ ID NO: 427938 - DNA, 27 bp, Artificial Sequence
  Description of Artificial Sequence: Synthetic oligonucleotide
cggtcgctgctgtgctgtggagaaaga

SEQ ID NO: 427939 - DNA, 28 bp, Artificial Sequence
  Description of Artificial Sequence: Synthetic oligonucleotide
ggtcgctgctgtgctgtggagaaagaag

SEQ ID NO: 427940 - DNA, 29 bp, Artificial Sequence
  Description of Artificial Sequence: Synthetic oligonucleotide
gtcgctgctgtgctgtggagaaagaagag

SEQ ID NO: 427941 - DNA, 29 bp, Artificial Sequence
  Description of Artificial Sequence: Synthetic oligonucleotide
tcgctgctgtgctgtggagaaagaagagc

SEQ ID NO: 427942 - DNA, 28 bp, Artificial Sequence
  Description of Artificial Sequence: Synthetic oligonucleotide
cgctgctgtgctgtggagaaagaagagc

SEQ ID NO: 427943 - DNA, 29 bp, Artificial Sequence
  Description of Artificial Sequence: Synthetic oligonucleotide
gctgctgtgctgtggagaaagaagagctc

SEQ ID NO: 427944 - DNA, 30 bp, Artificial Sequence; identical to SEQ ID NO: 77988
  Description of Artificial Sequence: Synthetic oligonucleotide

SEQ ID NO: 427945 - DNA, 33 bp, Artificial Sequence; identical to SEQ ID NO: 77989
  Description of Artificial Sequence: Synthetic oligonucleotide

SEQ ID NO: 427946 - DNA, 32 bp, Artificial Sequence; identical to SEQ ID NO: 77990
  Description of Artificial Sequence: Synthetic oligonucleotide

SEQ ID NO: 427947 - DNA, 27 bp, Artificial Sequence
  Description of Artificial Sequence: Synthetic oligonucleotide
tcaggccccacaggcggtgtatggatt

SEQ ID NO: 427948 - DNA, 26 bp, Artificial Sequence
  Description of Artificial Sequence: Synthetic oligonucleotide
caggccccacaggcggtgtatggatt

SEQ ID NO: 427949 - DNA, 26 bp, Artificial Sequence
  Description of Artificial Sequence: Synthetic oligonucleotide
aggccccacaggcggtgtatggattg

SEQ ID NO: 427950 - DNA, 25 bp, Artificial Sequence
  Description of Artificial Sequence: Synthetic oligonucleotide
ggccccacaggcggtgtatggattg

SEQ ID NO: 427951 - DNA, 25 bp, Artificial Sequence
  Description of Artificial Sequence: Synthetic oligonucleotide
gccccacaggcggtgtatggattgg

SEQ ID NO: 427952 - DNA, 25 bp, Artificial Sequence
  Description of Artificial Sequence: Synthetic oligonucleotide
ccccacaggcggtgtatggattggg

SEQ ID NO: 427953 - DNA, 26 bp, Artificial Sequence
  Description of Artificial Sequence: Synthetic oligonucleotide
cccacaggcggtgtatggattgggga

SEQ ID NO: 427954 - DNA, 26 bp, Artificial Sequence
  Description of Artificial Sequence: Synthetic oligonucleotide
ccacaggcggtgtatggattggggag

SEQ ID NO: 427955 - DNA, 26 bp, Artificial Sequence
  Description of Artificial Sequence: Synthetic oligonucleotide
cacaggcggtgtatggattggggagg

SEQ ID NO: 427956 - DNA, 26 bp, Artificial Sequence
  Description of Artificial Sequence: Synthetic oligonucleotide
acaggcggtgtatggattggggaggc

SEQ ID NO: 427957 - DNA, 25 bp, Artificial Sequence
  Description of Artificial Sequence: Synthetic oligonucleotide
caggcggtgtatggattggggaggc

SEQ ID NO: 427958 - DNA, 25 bp, Artificial Sequence
  Description of Artificial Sequence: Synthetic oligonucleotide
aggcggtgtatggattggggaggcc

SEQ ID NO: 427959 - DNA, 24 bp, Artificial Sequence
  Description of Artificial Sequence: Synthetic oligonucleotide
ggcggtgtatggattggggaggcc

SEQ ID NO: 427960 - DNA, 24 bp, Artificial Sequence
  Description of Artificial Sequence: Synthetic oligonucleotide
gcggtgtatggattggggaggccc

SEQ ID NO: 427961 - DNA, 24 bp, Artificial Sequence
  Description of Artificial Sequence: Synthetic oligonucleotide
cggtgtatggattggggaggcccc

SEQ ID NO: 427962 - DNA, 24 bp, Artificial Sequence
  Description of Artificial Sequence: Synthetic oligonucleotide
ggtgtatggattggggaggccccg

SEQ ID NO: 427963 - DNA, 24 bp, Artificial Sequence
  Description of Artificial Sequence: Synthetic oligonucleotide
gtgtatggattggggaggccccgc

SEQ ID NO: 427964 - DNA, 26 bp, Artificial Sequence
  Description of Artificial Sequence: Synthetic oligonucleotide
tgtatggattggggaggccccgcgtt

SEQ ID NO: 427965 - DNA, 25 bp, Artificial Sequence
  Description of Artificial Sequence: Synthetic oligonucleotide
gtatggattggggaggccccgcgtt

SEQ ID NO: 427966 - DNA, 25 bp, Artificial Sequence
  Description of Artificial Sequence: Synthetic oligonucleotide
tatggattggggaggccccgcgttg

SEQ ID NO: 427967 - DNA, 24 bp, Artificial Sequence
  Description of Artificial Sequence: Synthetic oligonucleotide
atggattggggaggccccgcgttg

SEQ ID NO: 427968 - DNA, 23 bp, Artificial Sequence
  Description of Artificial Sequence: Synthetic oligonucleotide
tggattggggaggccccgcgttg

SEQ ID NO: 427969 - DNA, 22 bp, Artificial Sequence
  Description of Artificial Sequence: Synthetic oligonucleotide
ggattggggaggccccgcgttg

SEQ ID NO: 427970 - DNA, 22 bp, Artificial Sequence
  Description of Artificial Sequence: Synthetic oligonucleotide
gattggggaggccccgcgttgg

SEQ ID NO: 427971 - DNA, 22 bp, Artificial Sequence
  Description of Artificial Sequence: Synthetic oligonucleotide
attggggaggccccgcgttggg

SEQ ID NO: 427972 - DNA, 27 bp, Artificial Sequence
  Description of Artificial Sequence: Synthetic oligonucleotide
cagacgccaaggatggtggtcatggca

SEQ ID NO: 427973 - DNA, 27 bp, Artificial Sequence
  Description of Artificial Sequence: Synthetic oligonucleotide
agacgccaaggatggtggtcatggcac

SEQ ID NO: 427974 - DNA, 26 bp, Artificial Sequence
  Description of Artificial Sequence: Synthetic oligonucleotide
gacgccaaggatggtggtcatggcac

SEQ ID NO: 427975 - DNA, 26 bp, Artificial Sequence
  Description of Artificial Sequence: Synthetic oligonucleotide
acgccaaggatggtggtcatggcacc

SEQ ID NO: 427976 - DNA, 25 bp, Artificial Sequence
  Description of Artificial Sequence: Synthetic oligonucleotide
cgccaaggatggtggtcatggcacc

SEQ ID NO: 427977 - DNA, 25 bp, Artificial Sequence
  Description of Artificial Sequence: Synthetic oligonucleotide
gccaaggatggtggtcatggcaccc

SEQ ID NO: 427978 - DNA, 25 bp, Artificial Sequence
  Description of Artificial Sequence: Synthetic oligonucleotide
ccaaggatggtggtcatggcacccc

SEQ ID NO: 427979 - DNA, 27 bp, Artificial Sequence
  Description of Artificial Sequence: Synthetic oligonucleotide
caaggatggtggtcatggcaccccgaa

SEQ ID NO: 427980 - DNA, 27 bp, Artificial Sequence
  Description of Artificial Sequence: Synthetic oligonucleotide
aaggatggtggtcatggcaccccgaac

SEQ ID NO: 427981 - DNA, 26 bp, Artificial Sequence
  Description of Artificial Sequence: Synthetic oligonucleotide
aggatggtggtcatggcaccccgaac

SEQ ID NO: 427982 - DNA, 25 bp, Artificial Sequence
  Description of Artificial Sequence: Synthetic oligonucleotide
ggatggtggtcatggcaccccgaac

SEQ ID NO: 427983 - DNA, 25 bp, Artificial Sequence
  Description of Artificial Sequence: Synthetic oligonucleotide
gatggtggtcatggcaccccgaacc

SEQ ID NO: 427984 - DNA, 26 bp, Artificial Sequence
  Description of Artificial Sequence: Synthetic oligonucleotide
atggtggtcatggcaccccgaaccct

SEQ ID NO: 427985 - DNA, 25 bp, Artificial Sequence
  Description of Artificial Sequence: Synthetic oligonucleotide
tggtggtcatggcaccccgaaccct

SEQ ID NO: 427986 - DNA, 24 bp, Artificial Sequence
  Description of Artificial Sequence: Synthetic oligonucleotide
ggtggtcatggcaccccgaaccct

SEQ ID NO: 427987 - DNA, 26 bp, Artificial Sequence
  Description of Artificial Sequence: Synthetic oligonucleotide
gtggtcatggcaccccgaaccctctt

SEQ ID NO: 427988 - DNA, 26 bp, Artificial Sequence
  Description of Artificial Sequence: Synthetic oligonucleotide
tggtcatggcaccccgaaccctcttc

SEQ ID NO: 427989 - DNA, 25 bp, Artificial Sequence
  Description of Artificial Sequence: Synthetic oligonucleotide
ggtcatggcaccccgaaccctcttc

SEQ ID NO: 427990 - DNA, 26 bp, Artificial Sequence
  Description of Artificial Sequence: Synthetic oligonucleotide
gtcatggcaccccgaaccctcttcct

SEQ ID NO: 427991 - DNA, 26 bp, Artificial Sequence
  Description of Artificial Sequence: Synthetic oligonucleotide
tcatggcaccccgaaccctcttcctg

SEQ ID NO: 427992 - DNA, 25 bp, Artificial Sequence
  Description of Artificial Sequence: Synthetic oligonucleotide
catggcaccccgaaccctcttcctg

SEQ ID NO: 427993 - DNA, 27 bp, Artificial Sequence
  Description of Artificial Sequence: Synthetic oligonucleotide
atggcaccccgaaccctcttcctgcta

SEQ ID NO: 427994 - DNA, 26 bp, Artificial Sequence
  Description of Artificial Sequence: Synthetic oligonucleotide
tggcaccccgaaccctcttcctgcta

SEQ ID NO: 427995 - DNA, 25 bp, Artificial Sequence
  Description of Artificial Sequence: Synthetic oligonucleotide
ggcaccccgaaccctcttcctgcta

SEQ ID NO: 427996 - DNA, 26 bp, Artificial Sequence
  Description of Artificial Sequence: Synthetic oligonucleotide
gcaccccgaaccctcttcctgctact

SEQ ID NO: 427997 - DNA, 27 bp, Artificial Sequence
  Description of Artificial Sequence: Synthetic oligonucleotide
caccccgaaccctcttcctgctactct

SEQ ID NO: 427998 - DNA, 27 bp, Artificial Sequence
  Description of Artificial Sequence: Synthetic oligonucleotide
accccgaaccctcttcctgctactctc

SEQ ID NO: 427999 - DNA, 26 bp, Artificial Sequence
  Description of Artificial Sequence: Synthetic oligonucleotide
ccccgaaccctcttcctgctactctc

SEQ ID NO: 428000 - DNA, 26 bp, Artificial Sequence
  Description of Artificial Sequence: Synthetic oligonucleotide
cccgaaccctcttcctgctactctcg

SEQ ID NO: 428001 - DNA, 26 bp, Artificial Sequence
  Description of Artificial Sequence: Synthetic oligonucleotide
ccgaaccctcttcctgctactctcgg

SEQ ID NO: 428002 - DNA, 26 bp, Artificial Sequence
  Description of Artificial Sequence: Synthetic oligonucleotide
cgaaccctcttcctgctactctcggg

SEQ ID NO: 428003 - DNA, 26 bp, Artificial Sequence
  Description of Artificial Sequence: Synthetic oligonucleotide
gaaccctcttcctgctactctcgggg

SEQ ID NO: 428004 - DNA, 26 bp, Artificial Sequence
  Description of Artificial Sequence: Synthetic oligonucleotide
aaccctcttcctgctactctcggggg

SEQ ID NO: 428005 - DNA, 25 bp, Artificial Sequence
  Description of Artificial Sequence: Synthetic oligonucleotide
accctcttcctgctactctcggggg

SEQ ID NO: 428006 - DNA, 24 bp, Artificial Sequence
  Description of Artificial Sequence: Synthetic oligonucleotide
ccctcttcctgctactctcggggg

SEQ ID NO: 428007 - DNA, 24 bp, Artificial Sequence
  Description of Artificial Sequence: Synthetic oligonucleotide
cctcttcctgctactctcgggggc

SEQ ID NO: 428008 - DNA, 24 bp, Artificial Sequence
  Description of Artificial Sequence: Synthetic oligonucleotide
ctcttcctgctactctcgggggcc

SEQ ID NO: 428009 - DNA, 25 bp, Artificial Sequence
  Description of Artificial Sequence: Synthetic oligonucleotide
tcttcctgctactctcgggggccct

SEQ ID NO: 428010 - DNA, 24 bp, Artificial Sequence
  Description of Artificial Sequence: Synthetic oligonucleotide
cttcctgctactctcgggggccct

SEQ ID NO: 428011 - DNA, 25 bp, Artificial Sequence
  Description of Artificial Sequence: Synthetic oligonucleotide
ttcctgctactctcgggggccctga

SEQ ID NO: 428012 - DNA, 24 bp, Artificial Sequence
  Description of Artificial Sequence: Synthetic oligonucleotide
tcctgctactctcgggggccctga

SEQ ID NO: 428013 - DNA, 23 bp, Artificial Sequence
  Description of Artificial Sequence: Synthetic oligonucleotide
cctgctactctcgggggccctga

SEQ ID NO: 428014 - DNA, 23 bp, Artificial Sequence
  Description of Artificial Sequence: Synthetic oligonucleotide
ctgctactctcgggggccctgac

SEQ ID NO: 428015 - DNA, 23 bp, Artificial Sequence
  Description of Artificial Sequence: Synthetic oligonucleotide
tgctactctcgggggccctgacc

SEQ ID NO: 428016 - DNA, 22 bp, Artificial Sequence
  Description of Artificial Sequence: Synthetic oligonucleotide
gctactctcgggggccctgacc

SEQ ID NO: 428017 - DNA, 23 bp, Artificial Sequence
  Description of Artificial Sequence: Synthetic oligonucleotide
ctactctcgggggccctgaccct

SEQ ID NO: 428018 - DNA, 24 bp, Artificial Sequence
  Description of Artificial Sequence: Synthetic oligonucleotide
tactctcgggggccctgaccctga

SEQ ID NO: 428019 - DNA, 23 bp, Artificial Sequence
  Description of Artificial Sequence: Synthetic oligonucleotide
actctcgggggccctgaccctga

SEQ ID NO: 428020 - DNA, 27 bp, Artificial Sequence
  Description of Artificial Sequence: Synthetic oligonucleotide
gagcaggaggggccagagtattgggaa

SEQ ID NO: 428021 - DNA, 27 bp, Artificial Sequence
  Description of Artificial Sequence: Synthetic oligonucleotide
agcaggaggggccagagtattgggaag

SEQ ID NO: 428022 - DNA, 27 bp, Artificial Sequence
  Description of Artificial Sequence: Synthetic oligonucleotide
gcaggaggggccagagtattgggaaga

SEQ ID NO: 428023 - DNA, 27 bp, Artificial Sequence
  Description of Artificial Sequence: Synthetic oligonucleotide
caggaggggccagagtattgggaagag

SEQ ID NO: 428024 - DNA, 27 bp, Artificial Sequence
  Description of Artificial Sequence: Synthetic oligonucleotide
aggaggggccagagtattgggaagagg

SEQ ID NO: 428025 - DNA, 27 bp, Artificial Sequence
  Description of Artificial Sequence: Synthetic oligonucleotide
ggaggggccagagtattgggaagagga

SEQ ID NO: 428026 - DNA, 27 bp, Artificial Sequence
  Description of Artificial Sequence: Synthetic oligonucleotide
gaggggccagagtattgggaagaggag

SEQ ID NO: 428027 - DNA, 28 bp, Artificial Sequence
  Description of Artificial Sequence: Synthetic oligonucleotide
aggggccagagtattgggaagaggagac

SEQ ID NO: 428028 - DNA, 27 bp, Artificial Sequence
  Description of Artificial Sequence: Synthetic oligonucleotide
ggggccagagtattgggaagaggagac

SEQ ID NO: 428029 - DNA, 28 bp, Artificial Sequence
  Description of Artificial Sequence: Synthetic oligonucleotide
gggccagagtattgggaagaggagacac

SEQ ID NO: 428030 - DNA, 28 bp, Artificial Sequence
  Description of Artificial Sequence: Synthetic oligonucleotide
ggccagagtattgggaagaggagacacg

SEQ ID NO: 428031 - DNA, 28 bp, Artificial Sequence
  Description of Artificial Sequence: Synthetic oligonucleotide
gccagagtattgggaagaggagacacgg

SEQ ID NO: 428032 - DNA, 30 bp, Artificial Sequence; identical to SEQ ID NO: 78039
  Description of Artificial Sequence: Synthetic oligonucleotide

SEQ ID NO: 428033 - DNA, 31 bp, Artificial Sequence; identical to SEQ ID NO: 78040
  Description of Artificial Sequence: Synthetic oligonucleotide

SEQ ID NO: 428034 - DNA, 31 bp, Artificial Sequence; identical to SEQ ID NO: 78041
  Description of Artificial Sequence: Synthetic oligonucleotide

SEQ ID NO: 428035 - DNA, 32 bp, Artificial Sequence; identical to SEQ ID NO: 78042
  Description of Artificial Sequence: Synthetic oligonucleotide

SEQ ID NO: 428036 - DNA, 31 bp, Artificial Sequence; identical to SEQ ID NO: 78043
  Description of Artificial Sequence: Synthetic oligonucleotide

SEQ ID NO: 428037 - DNA, 30 bp, Artificial Sequence; identical to SEQ ID NO: 78044
  Description of Artificial Sequence: Synthetic oligonucleotide

SEQ ID NO: 428038 - DNA, 30 bp, Artificial Sequence; identical to SEQ ID NO: 78045
  Description of Artificial Sequence: Synthetic oligonucleotide

SEQ ID NO: 428039 - DNA, 29 bp, Artificial Sequence
  Description of Artificial Sequence: Synthetic oligonucleotide
acaaccagagcgaggccagttctcatacc

SEQ ID NO: 428040 - DNA, 28 bp, Artificial Sequence
  Description of Artificial Sequence: Synthetic oligonucleotide
caaccagagcgaggccagttctcatacc

SEQ ID NO: 428041 - DNA, 28 bp, Artificial Sequence
  Description of Artificial Sequence: Synthetic oligonucleotide
aaccagagcgaggccagttctcataccc

SEQ ID NO: 428042 - DNA, 27 bp, Artificial Sequence
  Description of Artificial Sequence: Synthetic oligonucleotide
accagagcgaggccagttctcataccc

SEQ ID NO: 428043 - DNA, 27 bp, Artificial Sequence
  Description of Artificial Sequence: Synthetic oligonucleotide
ccagagcgaggccagttctcataccct

SEQ ID NO: 428044 - DNA, 27 bp, Artificial Sequence
  Description of Artificial Sequence: Synthetic oligonucleotide
cagagcgaggccagttctcataccctc

SEQ ID NO: 428045 - DNA, 27 bp, Artificial Sequence
  Description of Artificial Sequence: Synthetic oligonucleotide
agagcgaggccagttctcataccctcc

SEQ ID NO: 428046 - DNA, 27 bp, Artificial Sequence
  Description of Artificial Sequence: Synthetic oligonucleotide
gagcgaggccagttctcataccctcca

SEQ ID NO: 428047 - DNA, 27 bp, Artificial Sequence
  Description of Artificial Sequence: Synthetic oligonucleotide
agcgaggccagttctcataccctccag

SEQ ID NO: 428048 - DNA, 27 bp, Artificial Sequence
  Description of Artificial Sequence: Synthetic oligonucleotide
gcgaggccagttctcataccctccagt

SEQ ID NO: 428049 - DNA, 27 bp, Artificial Sequence
  Description of Artificial Sequence: Synthetic oligonucleotide
cgaggccagttctcataccctccagtg

SEQ ID NO: 428050 - DNA, 27 bp, Artificial Sequence
  Description of Artificial Sequence: Synthetic oligonucleotide
gaggccagttctcataccctccagtgg

SEQ ID NO: 428051 - DNA, 29 bp, Artificial Sequence
  Description of Artificial Sequence: Synthetic oligonucleotide
aggccagttctcataccctccagtggatg

SEQ ID NO: 428052 - DNA, 28 bp, Artificial Sequence
  Description of Artificial Sequence: Synthetic oligonucleotide
ggccagttctcataccctccagtggatg

SEQ ID NO: 428053 - DNA, 31 bp, Artificial Sequence; identical to SEQ ID NO: 78060
  Description of Artificial Sequence: Synthetic oligonucleotide

SEQ ID NO: 428054 - DNA, 31 bp, Artificial Sequence; identical to SEQ ID NO: 78061
  Description of Artificial Sequence: Synthetic oligonucleotide

SEQ ID NO: 428055 - DNA, 31 bp, Artificial Sequence; identical to SEQ ID NO: 78062
  Description of Artificial Sequence: Synthetic oligonucleotide

SEQ ID NO: 428056 - DNA, 32 bp, Artificial Sequence; identical to SEQ ID NO: 78063
  Description of Artificial Sequence: Synthetic oligonucleotide

SEQ ID NO: 428057 - DNA, 31 bp, Artificial Sequence; identical to SEQ ID NO: 78064
  Description of Artificial Sequence: Synthetic oligonucleotide

SEQ ID NO: 428058 - DNA, 31 bp, Artificial Sequence; identical to SEQ ID NO: 78065
  Description of Artificial Sequence: Synthetic oligonucleotide

SEQ ID NO: 428059 - DNA, 30 bp, Artificial Sequence; identical to SEQ ID NO: 78066
  Description of Artificial Sequence: Synthetic oligonucleotide

SEQ ID NO: 428060 - DNA, 29 bp, Artificial Sequence
  Description of Artificial Sequence: Synthetic oligonucleotide
ctcataccctccagtggatgattggctgc

SEQ ID NO: 428061 - DNA, 29 bp, Artificial Sequence
  Description of Artificial Sequence: Synthetic oligonucleotide
tcataccctccagtggatgattggctgcg

SEQ ID NO: 428062 - DNA, 28 bp, Artificial Sequence
  Description of Artificial Sequence: Synthetic oligonucleotide
cataccctccagtggatgattggctgcg

SEQ ID NO: 428063 - DNA, 29 bp, Artificial Sequence
  Description of Artificial Sequence: Synthetic oligonucleotide
ataccctccagtggatgattggctgcgac

SEQ ID NO: 428064 - DNA, 28 bp, Artificial Sequence
  Description of Artificial Sequence: Synthetic oligonucleotide
taccctccagtggatgattggctgcgac

SEQ ID NO: 428065 - DNA, 29 bp, Artificial Sequence
  Description of Artificial Sequence: Synthetic oligonucleotide
catccccatcatgggtatcgttgctggtc

SEQ ID NO: 428066 - DNA, 30 bp, Artificial Sequence; identical to SEQ ID NO: 78073
  Description of Artificial Sequence: Synthetic oligonucleotide

SEQ ID NO: 428067 - DNA, 29 bp, Artificial Sequence
  Description of Artificial Sequence: Synthetic oligonucleotide
tccccatcatgggtatcgttgctggtctg

SEQ ID NO: 428068 - DNA, 28 bp, Artificial Sequence
  Description of Artificial Sequence: Synthetic oligonucleotide
ccccatcatgggtatcgttgctggtctg

SEQ ID NO: 428069 - DNA, 28 bp, Artificial Sequence
  Description of Artificial Sequence: Synthetic oligonucleotide
cccatcatgggtatcgttgctggtctgg

SEQ ID NO: 428070 - DNA, 30 bp, Artificial Sequence; identical to SEQ ID NO: 78077
  Description of Artificial Sequence: Synthetic oligonucleotide

SEQ ID NO: 428071 - DNA, 31 bp, Artificial Sequence; identical to SEQ ID NO: 78078
  Description of Artificial Sequence: Synthetic oligonucleotide

SEQ ID NO: 428072 - DNA, 31 bp, Artificial Sequence; identical to SEQ ID NO: 78079
  Description of Artificial Sequence: Synthetic oligonucleotide

SEQ ID NO: 428073 - DNA, 30 bp, Artificial Sequence; identical to SEQ ID NO: 78080
  Description of Artificial Sequence: Synthetic oligonucleotide

SEQ ID NO: 428074 - DNA, 29 bp, Artificial Sequence
  Description of Artificial Sequence: Synthetic oligonucleotide
catgggtatcgttgctggtctggttgtcc

SEQ ID NO: 428075 - DNA, 31 bp, Artificial Sequence; identical to SEQ ID NO: 78082
  Description of Artificial Sequence: Synthetic oligonucleotide

SEQ ID NO: 428076 - DNA, 30 bp, Artificial Sequence; identical to SEQ ID NO: 78083
  Description of Artificial Sequence: Synthetic oligonucleotide

SEQ ID NO: 428077 - DNA, 29 bp, Artificial Sequence
  Description of Artificial Sequence: Synthetic oligonucleotide
gggtatcgttgctggtctggttgtccttg

SEQ ID NO: 428078 - DNA, 29 bp, Artificial Sequence
  Description of Artificial Sequence: Synthetic oligonucleotide
ggtatcgttgctggtctggttgtccttgc

SEQ ID NO: 428079 - DNA, 30 bp, Artificial Sequence; identical to SEQ ID NO: 78086
  Description of Artificial Sequence: Synthetic oligonucleotide

SEQ ID NO: 428080 - DNA, 30 bp, Artificial Sequence; identical to SEQ ID NO: 78087
  Description of Artificial Sequence: Synthetic oligonucleotide

SEQ ID NO: 428081 - DNA, 29 bp, Artificial Sequence
  Description of Artificial Sequence: Synthetic oligonucleotide
atcgttgctggtctggttgtccttgcagc

SEQ ID NO: 428082 - DNA, 28 bp, Artificial Sequence
  Description of Artificial Sequence: Synthetic oligonucleotide
tcgttgctggtctggttgtccttgcagc

SEQ ID NO: 428083 - DNA, 27 bp, Artificial Sequence
  Description of Artificial Sequence: Synthetic oligonucleotide
cgttgctggtctggttgtccttgcagc

SEQ ID NO: 428084 - DNA, 28 bp, Artificial Sequence
  Description of Artificial Sequence: Synthetic oligonucleotide
gttgctggtctggttgtccttgcagctg

SEQ ID NO: 428085 - DNA, 30 bp, Artificial Sequence; identical to SEQ ID NO: 78092
  Description of Artificial Sequence: Synthetic oligonucleotide

SEQ ID NO: 428086 - DNA, 29 bp, Artificial Sequence
  Description of Artificial Sequence: Synthetic oligonucleotide
tgctggtctggttgtccttgcagctgtag

SEQ ID NO: 428087 - DNA, 28 bp, Artificial Sequence
  Description of Artificial Sequence: Synthetic oligonucleotide
gctggtctggttgtccttgcagctgtag

SEQ ID NO: 428088 - DNA, 29 bp, Artificial Sequence
  Description of Artificial Sequence: Synthetic oligonucleotide
ctggtctggttgtccttgcagctgtagtc

SEQ ID NO: 428089 - DNA, 30 bp, Artificial Sequence; identical to SEQ ID NO: 78096
  Description of Artificial Sequence: Synthetic oligonucleotide

SEQ ID NO: 428090 - DNA, 29 bp, Artificial Sequence
  Description of Artificial Sequence: Synthetic oligonucleotide
ggtctggttgtccttgcagctgtagtcac

SEQ ID NO: 428091 - DNA, 30 bp, Artificial Sequence; identical to SEQ ID NO: 78098
  Description of Artificial Sequence: Synthetic oligonucleotide

SEQ ID NO: 428092 - DNA, 30 bp, Artificial Sequence; identical to SEQ ID NO: 78099
  Description of Artificial Sequence: Synthetic oligonucleotide

SEQ ID NO: 428093 - DNA, 24 bp, Artificial Sequence
  Description of Artificial Sequence: Synthetic oligonucleotide
tgcggtcgctgctgtgctgtggag

SEQ ID NO: 428094 - DNA, 23 bp, Artificial Sequence
  Description of Artificial Sequence: Synthetic oligonucleotide
gcggtcgctgctgtgctgtggag

SEQ ID NO: 428095 - DNA, 25 bp, Artificial Sequence
  Description of Artificial Sequence: Synthetic oligonucleotide
cggtcgctgctgtgctgtggaggaa

SEQ ID NO: 428096 - DNA, 27 bp, Artificial Sequence
  Description of Artificial Sequence: Synthetic oligonucleotide
ggtcgctgctgtgctgtggaggaagaa

SEQ ID NO: 428097 - DNA, 27 bp, Artificial Sequence
  Description of Artificial Sequence: Synthetic oligonucleotide
gtcgctgctgtgctgtggaggaagaag

SEQ ID NO: 428098 - DNA, 28 bp, Artificial Sequence
  Description of Artificial Sequence: Synthetic oligonucleotide
tcgctgctgtgctgtggaggaagaagag

SEQ ID NO: 428099 - DNA, 27 bp, Artificial Sequence
  Description of Artificial Sequence: Synthetic oligonucleotide
cgctgctgtgctgtggaggaagaagag

SEQ ID NO: 428100 - DNA, 27 bp, Artificial Sequence
  Description of Artificial Sequence: Synthetic oligonucleotide
gctgctgtgctgtggaggaagaagagc

SEQ ID NO: 428101 - DNA, 28 bp, Artificial Sequence
  Description of Artificial Sequence: Synthetic oligonucleotide
ctgctgtgctgtggaggaagaagagctc

SEQ ID NO: 428102 - DNA, 29 bp, Artificial Sequence
  Description of Artificial Sequence: Synthetic oligonucleotide
tgctgtgctgtggaggaagaagagctcag

SEQ ID NO: 428103 - DNA, 28 bp, Artificial Sequence
  Description of Artificial Sequence: Synthetic oligonucleotide
gctgtgctgtggaggaagaagagctcag

SEQ ID NO: 428104 - DNA, 31 bp, Artificial Sequence; identical to SEQ ID NO: 78111
  Description of Artificial Sequence: Synthetic oligonucleotide

SEQ ID NO: 428105 - DNA, 22 bp, Artificial Sequence
  Description of Artificial Sequence: Synthetic oligonucleotide
ctgcgacctggggtccgacggt

SEQ ID NO: 428106 - DNA, 22 bp, Artificial Sequence
  Description of Artificial Sequence: Synthetic oligonucleotide
tgcgacctggggtccgacggtc

SEQ ID NO: 428107 - DNA, 21 bp, Artificial Sequence
  Description of Artificial Sequence: Synthetic oligonucleotide
gcgacctggggtccgacggtc

SEQ ID NO: 428108 - DNA, 21 bp, Artificial Sequence
  Description of Artificial Sequence: Synthetic oligonucleotide
cgacctggggtccgacggtcg

SEQ ID NO: 428109 - DNA, 21 bp, Artificial Sequence
  Description of Artificial Sequence: Synthetic oligonucleotide
gacctggggtccgacggtcgc

SEQ ID NO: 428110 - DNA, 22 bp, Artificial Sequence
  Description of Artificial Sequence: Synthetic oligonucleotide
acctggggtccgacggtcgcct

SEQ ID NO: 428111 - DNA, 21 bp, Artificial Sequence
  Description of Artificial Sequence: Synthetic oligonucleotide
cctggggtccgacggtcgcct

SEQ ID NO: 428112 - DNA, 21 bp, Artificial Sequence
  Description of Artificial Sequence: Synthetic oligonucleotide
ctggggtccgacggtcgcctc

SEQ ID NO: 428113 - DNA, 22 bp, Artificial Sequence
  Description of Artificial Sequence: Synthetic oligonucleotide
tggggtccgacggtcgcctcct

SEQ ID NO: 428114 - DNA, 21 bp, Artificial Sequence
  Description of Artificial Sequence: Synthetic oligonucleotide
ggggtccgacggtcgcctcct

SEQ ID NO: 428115 - DNA, 21 bp, Artificial Sequence
  Description of Artificial Sequence: Synthetic oligonucleotide
gggtccgacggtcgcctcctc

SEQ ID NO: 428116 - DNA, 21 bp, Artificial Sequence
  Description of Artificial Sequence: Synthetic oligonucleotide
ggtccgacggtcgcctcctcc

SEQ ID NO: 428117 - DNA, 21 bp, Artificial Sequence
  Description of Artificial Sequence: Synthetic oligonucleotide
gtccgacggtcgcctcctccg

SEQ ID NO: 428118 - DNA, 21 bp, Artificial Sequence
  Description of Artificial Sequence: Synthetic oligonucleotide
tccgacggtcgcctcctccgc

SEQ ID NO: 428119 - DNA, 20 bp, Artificial Sequence
  Description of Artificial Sequence: Synthetic oligonucleotide
ccgacggtcgcctcctccgc

SEQ ID NO: 428120 - DNA, 20 bp, Artificial Sequence
  Description of Artificial Sequence: Synthetic oligonucleotide
cgacggtcgcctcctccgcg

SEQ ID NO: 428121 - DNA, 23 bp, Artificial Sequence
  Description of Artificial Sequence: Synthetic oligonucleotide
acggtcgcctcctccgcgggtat

SEQ ID NO: 428122 - DNA, 22 bp, Artificial Sequence
  Description of Artificial Sequence: Synthetic oligonucleotide
cggtcgcctcctccgcgggtat

SEQ ID NO: 428123 - DNA, 24 bp, Artificial Sequence
  Description of Artificial Sequence: Synthetic oligonucleotide
ggtcgcctcctccgcgggtatgaa

SEQ ID NO: 428124 - DNA, 25 bp, Artificial Sequence
  Description of Artificial Sequence: Synthetic oligonucleotide
gtcgcctcctccgcgggtatgaaca

SEQ ID NO: 428125 - DNA, 27 bp, Artificial Sequence
  Description of Artificial Sequence: Synthetic oligonucleotide
tcgcctcctccgcgggtatgaacagta

SEQ ID NO: 428126 - DNA, 28 bp, Artificial Sequence
  Description of Artificial Sequence: Synthetic oligonucleotide
gaagaggagacacggaacaccaaggctc

SEQ ID NO: 428127 - DNA, 29 bp, Artificial Sequence
  Description of Artificial Sequence: Synthetic oligonucleotide
aagaggagacacggaacaccaaggctcac

SEQ ID NO: 428128 - DNA, 28 bp, Artificial Sequence
  Description of Artificial Sequence: Synthetic oligonucleotide
agaggagacacggaacaccaaggctcac

SEQ ID NO: 428129 - DNA, 27 bp, Artificial Sequence
  Description of Artificial Sequence: Synthetic oligonucleotide
gaggagacacggaacaccaaggctcac

SEQ ID NO: 428130 - DNA, 27 bp, Artificial Sequence
  Description of Artificial Sequence: Synthetic oligonucleotide
aggagacacggaacaccaaggctcacg

SEQ ID NO: 428131 - DNA, 26 bp, Artificial Sequence
  Description of Artificial Sequence: Synthetic oligonucleotide
ggagacacggaacaccaaggctcacg

SEQ ID NO: 428132 - DNA, 27 bp, Artificial Sequence
  Description of Artificial Sequence: Synthetic oligonucleotide
gagacacggaacaccaaggctcacgca

SEQ ID NO: 428133 - DNA, 27 bp, Artificial Sequence
  Description of Artificial Sequence: Synthetic oligonucleotide
agacacggaacaccaaggctcacgcac

SEQ ID NO: 428134 - DNA, 27 bp, Artificial Sequence
  Description of Artificial Sequence: Synthetic oligonucleotide
gacacggaacaccaaggctcacgcaca

SEQ ID NO: 428135 - DNA, 27 bp, Artificial Sequence
  Description of Artificial Sequence: Synthetic oligonucleotide
acacggaacaccaaggctcacgcacag

SEQ ID NO: 428136 - DNA, 27 bp, Artificial Sequence
  Description of Artificial Sequence: Synthetic oligonucleotide
cacggaacaccaaggctcacgcacaga

SEQ ID NO: 428137 - DNA, 27 bp, Artificial Sequence
  Description of Artificial Sequence: Synthetic oligonucleotide
acggaacaccaaggctcacgcacagac

SEQ ID NO: 428138 - DNA, 27 bp, Artificial Sequence
  Description of Artificial Sequence: Synthetic oligonucleotide
cggaacaccaaggctcacgcacagact

SEQ ID NO: 428139 - DNA, 27 bp, Artificial Sequence
  Description of Artificial Sequence: Synthetic oligonucleotide
ggaacaccaaggctcacgcacagactg

SEQ ID NO: 428140 - DNA, 28 bp, Artificial Sequence
  Description of Artificial Sequence: Synthetic oligonucleotide
gaacaccaaggctcacgcacagactgac

SEQ ID NO: 428141 - DNA, 29 bp, Artificial Sequence
  Description of Artificial Sequence: Synthetic oligonucleotide
aacaccaaggctcacgcacagactgacag

SEQ ID NO: 428142 - DNA, 28 bp, Artificial Sequence
  Description of Artificial Sequence: Synthetic oligonucleotide
acaccaaggctcacgcacagactgacag

SEQ ID NO: 428143 - DNA, 27 bp, Artificial Sequence
  Description of Artificial Sequence: Synthetic oligonucleotide
caccaaggctcacgcacagactgacag

SEQ ID NO: 428144 - DNA, 30 bp, Artificial Sequence; identical to SEQ ID NO: 78152
  Description of Artificial Sequence: Synthetic oligonucleotide

SEQ ID NO: 428145 - DNA, 29 bp, Artificial Sequence
  Description of Artificial Sequence: Synthetic oligonucleotide
ccaaggctcacgcacagactgacagaatg

SEQ ID NO: 428146 - DNA, 31 bp, Artificial Sequence; identical to SEQ ID NO: 78154
  Description of Artificial Sequence: Synthetic oligonucleotide

SEQ ID NO: 428147 - DNA, 31 bp, Artificial Sequence; identical to SEQ ID NO: 78155
  Description of Artificial Sequence: Synthetic oligonucleotide

SEQ ID NO: 428148 - DNA, 30 bp, Artificial Sequence; identical to SEQ ID NO: 78156
  Description of Artificial Sequence: Synthetic oligonucleotide

SEQ ID NO: 428149 - DNA, 29 bp, Artificial Sequence
  Description of Artificial Sequence: Synthetic oligonucleotide
ggctcacgcacagactgacagaatgaacc

SEQ ID NO: 428150 - DNA, 30 bp, Artificial Sequence; identical to SEQ ID NO: 78158
  Description of Artificial Sequence: Synthetic oligonucleotide

SEQ ID NO: 428151 - DNA, 30 bp, Artificial Sequence; identical to SEQ ID NO: 78159
  Description of Artificial Sequence: Synthetic oligonucleotide

SEQ ID NO: 428152 - DNA, 31 bp, Artificial Sequence; identical to SEQ ID NO: 78160
  Description of Artificial Sequence: Synthetic oligonucleotide

SEQ ID NO: 428153 - DNA, 26 bp, Artificial Sequence
  Description of Artificial Sequence: Synthetic oligonucleotide
agaagccaatcagcgtcgccgcggtt

SEQ ID NO: 428154 - DNA, 25 bp, Artificial Sequence
  Description of Artificial Sequence: Synthetic oligonucleotide
gaagccaatcagcgtcgccgcggtt

SEQ ID NO: 428155 - DNA, 26 bp, Artificial Sequence
  Description of Artificial Sequence: Synthetic oligonucleotide
aagccaatcagcgtcgccgcggttct

SEQ ID NO: 428156 - DNA, 25 bp, Artificial Sequence
  Description of Artificial Sequence: Synthetic oligonucleotide
agccaatcagcgtcgccgcggttct

SEQ ID NO: 428157 - DNA, 24 bp, Artificial Sequence
  Description of Artificial Sequence: Synthetic oligonucleotide
gccaatcagcgtcgccgcggttct

SEQ ID NO: 428158 - DNA, 24 bp, Artificial Sequence
  Description of Artificial Sequence: Synthetic oligonucleotide
ccaatcagcgtcgccgcggttctg

SEQ ID NO: 428159 - DNA, 26 bp, Artificial Sequence
  Description of Artificial Sequence: Synthetic oligonucleotide
caatcagcgtcgccgcggttctggtt

SEQ ID NO: 428160 - DNA, 27 bp, Artificial Sequence
  Description of Artificial Sequence: Synthetic oligonucleotide
aatcagcgtcgccgcggttctggttct

SEQ ID NO: 428161 - DNA, 27 bp, Artificial Sequence
  Description of Artificial Sequence: Synthetic oligonucleotide
atcagcgtcgccgcggttctggttcta

SEQ ID NO: 428162 - DNA, 27 bp, Artificial Sequence
  Description of Artificial Sequence: Synthetic oligonucleotide
tcagcgtcgccgcggttctggttctaa

SEQ ID NO: 428163 - DNA, 27 bp, Artificial Sequence
  Description of Artificial Sequence: Synthetic oligonucleotide
cagcgtcgccgcggttctggttctaaa

SEQ ID NO: 428164 - DNA, 27 bp, Artificial Sequence
  Description of Artificial Sequence: Synthetic oligonucleotide
agcgtcgccgcggttctggttctaaag

SEQ ID NO: 428165 - DNA, 27 bp, Artificial Sequence
  Description of Artificial Sequence: Synthetic oligonucleotide
gcgtcgccgcggttctggttctaaagt

SEQ ID NO: 428166 - DNA, 27 bp, Artificial Sequence
  Description of Artificial Sequence: Synthetic oligonucleotide
cgtcgccgcggttctggttctaaagtc

SEQ ID NO: 428167 - DNA, 27 bp, Artificial Sequence
  Description of Artificial Sequence: Synthetic oligonucleotide
gtcgccgcggttctggttctaaagtcc

SEQ ID NO: 428168 - DNA, 28 bp, Artificial Sequence
  Description of Artificial Sequence: Synthetic oligonucleotide
tcgccgcggttctggttctaaagtcctc

SEQ ID NO: 428169 - DNA, 27 bp, Artificial Sequence
  Description of Artificial Sequence: Synthetic oligonucleotide
cgccgcggttctggttctaaagtcctc

SEQ ID NO: 428170 - DNA, 27 bp, Artificial Sequence
  Description of Artificial Sequence: Synthetic oligonucleotide
gccgcggttctggttctaaagtcctcg

SEQ ID NO: 428171 - DNA, 27 bp, Artificial Sequence
  Description of Artificial Sequence: Synthetic oligonucleotide
ccgcggttctggttctaaagtcctcgc

SEQ ID NO: 428172 - DNA, 28 bp, Artificial Sequence
  Description of Artificial Sequence: Synthetic oligonucleotide
cgcggttctggttctaaagtcctcgctc

SEQ ID NO: 428173 - DNA, 29 bp, Artificial Sequence
  Description of Artificial Sequence: Synthetic oligonucleotide
gcggttctggttctaaagtcctcgctcac

SEQ ID NO: 428174 - DNA, 29 bp, Artificial Sequence
  Description of Artificial Sequence: Synthetic oligonucleotide
cggttctggttctaaagtcctcgctcacc

SEQ ID NO: 428175 - DNA, 29 bp, Artificial Sequence
  Description of Artificial Sequence: Synthetic oligonucleotide
ggttctggttctaaagtcctcgctcaccc

SEQ ID NO: 428176 - DNA, 30 bp, Artificial Sequence
  Description of Artificial Sequence: Synthetic oligonucleotide
gttctggttctaaagtcctcgctcacccac

SEQ ID NO: 428177 - DNA, 30 bp, Artificial Sequence
  Description of Artificial Sequence: Synthetic oligonucleotide
ttctggttctaaagtcctcgctcacccacc

SEQ ID NO: 428178 - DNA, 29 bp, Artificial Sequence
  Description of Artificial Sequence: Synthetic oligonucleotide
tctggttctaaagtcctcgctcacccacc

SEQ ID NO: 428179 - DNA, 23 bp, Artificial Sequence
  Description of Artificial Sequence: Synthetic oligonucleotide
gcgcggacccccccaagacacat

SEQ ID NO: 428180 - DNA, 24 bp, Artificial Sequence
  Description of Artificial Sequence: Synthetic oligonucleotide
cgcggacccccccaagacacatgt

SEQ ID NO: 428181 - DNA, 25 bp, Artificial Sequence
  Description of Artificial Sequence: Synthetic oligonucleotide
gcggacccccccaagacacatgtga

SEQ ID NO: 428182 - DNA, 25 bp, Artificial Sequence
  Description of Artificial Sequence: Synthetic oligonucleotide
cggacccccccaagacacatgtgac

SEQ ID NO: 428183 - DNA, 25 bp, Artificial Sequence
  Description of Artificial Sequence: Synthetic oligonucleotide
ggacccccccaagacacatgtgacc

SEQ ID NO: 428184 - DNA, 26 bp, Artificial Sequence
  Description of Artificial Sequence: Synthetic oligonucleotide
gacccccccaagacacatgtgaccca

SEQ ID NO: 428185 - DNA, 26 bp, Artificial Sequence
  Description of Artificial Sequence: Synthetic oligonucleotide
acccccccaagacacatgtgacccac

SEQ ID NO: 428186 - DNA, 25 bp, Artificial Sequence
  Description of Artificial Sequence: Synthetic oligonucleotide
cccccccaagacacatgtgacccac

SEQ ID NO: 428187 - DNA, 26 bp, Artificial Sequence
  Description of Artificial Sequence: Synthetic oligonucleotide
ccccccaagacacatgtgacccacca

SEQ ID NO: 428188 - DNA, 26 bp, Artificial Sequence
  Description of Artificial Sequence: Synthetic oligonucleotide
cccccaagacacatgtgacccaccac

SEQ ID NO: 428189 - DNA, 26 bp, Artificial Sequence
  Description of Artificial Sequence: Synthetic oligonucleotide
ccccaagacacatgtgacccaccacc

SEQ ID NO: 428190 - DNA, 27 bp, Artificial Sequence
  Description of Artificial Sequence: Synthetic oligonucleotide
cccaagacacatgtgacccaccaccct

SEQ ID NO: 428191 - DNA, 27 bp, Artificial Sequence
  Description of Artificial Sequence: Synthetic oligonucleotide
ccaagacacatgtgacccaccaccctg

SEQ ID NO: 428192 - DNA, 28 bp, Artificial Sequence
  Description of Artificial Sequence: Synthetic oligonucleotide
caagacacatgtgacccaccaccctgtc

SEQ ID NO: 428193 - DNA, 31 bp, Artificial Sequence; identical to SEQ ID NO: 78175
  Description of Artificial Sequence: Synthetic oligonucleotide

SEQ ID NO: 428194 - DNA, 30 bp, Artificial Sequence; identical to SEQ ID NO: 78176
  Description of Artificial Sequence: Synthetic oligonucleotide

SEQ ID NO: 428195 - DNA, 29 bp, Artificial Sequence
  Description of Artificial Sequence: Synthetic oligonucleotide
gacacatgtgacccaccaccctgtctttg

SEQ ID NO: 428196 - DNA, 30 bp, Artificial Sequence; identical to SEQ ID NO: 78178
  Description of Artificial Sequence: Synthetic oligonucleotide

SEQ ID NO: 428197 - DNA, 29 bp, Artificial Sequence
  Description of Artificial Sequence: Synthetic oligonucleotide
cacatgtgacccaccaccctgtctttgac

SEQ ID NO: 428198 - DNA, 32 bp, Artificial Sequence; identical to SEQ ID NO: 78180
  Description of Artificial Sequence: Synthetic oligonucleotide

SEQ ID NO: 428199 - DNA, 31 bp, Artificial Sequence; identical to SEQ ID NO: 78181
  Description of Artificial Sequence: Synthetic oligonucleotide

SEQ ID NO: 428200 - DNA, 32 bp, Artificial Sequence; identical to SEQ ID NO: 78182
  Description of Artificial Sequence: Synthetic oligonucleotide

SEQ ID NO: 428201 - DNA, 31 bp, Artificial Sequence; identical to SEQ ID NO: 78183
  Description of Artificial Sequence: Synthetic oligonucleotide

SEQ ID NO: 428202 - DNA, 24 bp, Artificial Sequence
  Description of Artificial Sequence: Synthetic oligonucleotide
ccggagcccctcatgctgagatgg

SEQ ID NO: 428203 - DNA, 29 bp, Artificial Sequence
  Description of Artificial Sequence: Synthetic oligonucleotide
ggctcagatctccaagcgcaagtgtgaag

SEQ ID NO: 428204 - DNA, 29 bp, Artificial Sequence
  Description of Artificial Sequence: Synthetic oligonucleotide
gctcagatctccaagcgcaagtgtgaagc

SEQ ID NO: 428205 - DNA, 29 bp, Artificial Sequence
  Description of Artificial Sequence: Synthetic oligonucleotide
ctcagatctccaagcgcaagtgtgaagcg

SEQ ID NO: 428206 - DNA, 29 bp, Artificial Sequence
  Description of Artificial Sequence: Synthetic oligonucleotide
tcagatctccaagcgcaagtgtgaagcgg

SEQ ID NO: 428207 - DNA, 28 bp, Artificial Sequence
  Description of Artificial Sequence: Synthetic oligonucleotide
cagatctccaagcgcaagtgtgaagcgg

SEQ ID NO: 428208 - DNA, 28 bp, Artificial Sequence
  Description of Artificial Sequence: Synthetic oligonucleotide
agatctccaagcgcaagtgtgaagcggc

SEQ ID NO: 428209 - DNA, 27 bp, Artificial Sequence
  Description of Artificial Sequence: Synthetic oligonucleotide
gatctccaagcgcaagtgtgaagcggc

SEQ ID NO: 428210 - DNA, 27 bp, Artificial Sequence
  Description of Artificial Sequence: Synthetic oligonucleotide
atctccaagcgcaagtgtgaagcggcc

SEQ ID NO: 428211 - DNA, 27 bp, Artificial Sequence
  Description of Artificial Sequence: Synthetic oligonucleotide
tctccaagcgcaagtgtgaagcggcca

SEQ ID NO: 428212 - DNA, 27 bp, Artificial Sequence
  Description of Artificial Sequence: Synthetic oligonucleotide
ctccaagcgcaagtgtgaagcggccaa

SEQ ID NO: 428213 - DNA, 28 bp, Artificial Sequence
  Description of Artificial Sequence: Synthetic oligonucleotide
tccaagcgcaagtgtgaagcggccaatg

SEQ ID NO: 428214 - DNA, 27 bp, Artificial Sequence
  Description of Artificial Sequence: Synthetic oligonucleotide
ccaagcgcaagtgtgaagcggccaatg

SEQ ID NO: 428215 - DNA, 28 bp, Artificial Sequence
  Description of Artificial Sequence: Synthetic oligonucleotide
caagcgcaagtgtgaagcggccaatgtg

SEQ ID NO: 428216 - DNA, 28 bp, Artificial Sequence
  Description of Artificial Sequence: Synthetic oligonucleotide
aagcgcaagtgtgaagcggccaatgtgg

SEQ ID NO: 428217 - DNA, 27 bp, Artificial Sequence
  Description of Artificial Sequence: Synthetic oligonucleotide
agcgcaagtgtgaagcggccaatgtgg

SEQ ID NO: 428218 - DNA, 26 bp, Artificial Sequence
  Description of Artificial Sequence: Synthetic oligonucleotide
gcgcaagtgtgaagcggccaatgtgg

SEQ ID NO: 428219 - DNA, 27 bp, Artificial Sequence
  Description of Artificial Sequence: Synthetic oligonucleotide
cgcaagtgtgaagcggccaatgtggct

SEQ ID NO: 428220 - DNA, 27 bp, Artificial Sequence
  Description of Artificial Sequence: Synthetic oligonucleotide
gcaagtgtgaagcggccaatgtggctg

SEQ ID NO: 428221 - DNA, 29 bp, Artificial Sequence
  Description of Artificial Sequence: Synthetic oligonucleotide
caagtgtgaagcggccaatgtggctgaac

SEQ ID NO: 428222 - DNA, 32 bp, Artificial Sequence; identical to SEQ ID NO: 78204
  Description of Artificial Sequence: Synthetic oligonucleotide

SEQ ID NO: 428223 - DNA, 31 bp, Artificial Sequence; identical to SEQ ID NO: 78205
  Description of Artificial Sequence: Synthetic oligonucleotide

SEQ ID NO: 428224 - DNA, 30 bp, Artificial Sequence; identical to SEQ ID NO: 78206
  Description of Artificial Sequence: Synthetic oligonucleotide

SEQ ID NO: 428225 - DNA, 30 bp, Artificial Sequence; identical to SEQ ID NO: 78207
  Description of Artificial Sequence: Synthetic oligonucleotide

SEQ ID NO: 428226 - DNA, 29 bp, Artificial Sequence
  Description of Artificial Sequence: Synthetic oligonucleotide
gtgaagcggccaatgtggctgaacaaagg

SEQ ID NO: 428227 - DNA, 30 bp, Artificial Sequence; identical to SEQ ID NO: 78209
  Description of Artificial Sequence: Synthetic oligonucleotide

SEQ ID NO: 428228 - DNA, 29 bp, Artificial Sequence
  Description of Artificial Sequence: Synthetic oligonucleotide
gaagcggccaatgtggctgaacaaaggag

SEQ ID NO: 428229 - DNA, 30 bp, Artificial Sequence; identical to SEQ ID NO: 78211
  Description of Artificial Sequence: Synthetic oligonucleotide

SEQ ID NO: 428230 - DNA, 29 bp, Artificial Sequence
  Description of Artificial Sequence: Synthetic oligonucleotide
agcggccaatgtggctgaacaaaggagag

SEQ ID NO: 428231 - DNA, 27 bp, Artificial Sequence
  Description of Artificial Sequence: Synthetic oligonucleotide
ctcctccgcgggtatgaacagtatgcg

SEQ ID NO: 428232 - DNA, 29 bp, Artificial Sequence
  Description of Artificial Sequence: Synthetic oligonucleotide
tcctccgcgggtatgaacagtatgcgtac

SEQ ID NO: 428233 - DNA, 28 bp, Artificial Sequence
  Description of Artificial Sequence: Synthetic oligonucleotide
cctccgcgggtatgaacagtatgcgtac

SEQ ID NO: 428234 - DNA, 28 bp, Artificial Sequence
  Description of Artificial Sequence: Synthetic oligonucleotide
ctccgcgggtatgaacagtatgcgtacg

SEQ ID NO: 428235 - DNA, 30 bp, Artificial Sequence; identical to SEQ ID NO: 78217
  Description of Artificial Sequence: Synthetic oligonucleotide

SEQ ID NO: 428236 - DNA, 29 bp, Artificial Sequence
  Description of Artificial Sequence: Synthetic oligonucleotide
ccgcgggtatgaacagtatgcgtacgatg

SEQ ID NO: 428237 - DNA, 29 bp, Artificial Sequence
  Description of Artificial Sequence: Synthetic oligonucleotide
cgcgggtatgaacagtatgcgtacgatgg

SEQ ID NO: 428238 - DNA, 29 bp, Artificial Sequence
  Description of Artificial Sequence: Synthetic oligonucleotide
gcgggtatgaacagtatgcgtacgatggc

SEQ ID NO: 428239 - DNA, 31 bp, Artificial Sequence; identical to SEQ ID NO: 78221
  Description of Artificial Sequence: Synthetic oligonucleotide

SEQ ID NO: 428240 - DNA, 31 bp, Artificial Sequence; identical to SEQ ID NO: 78222
  Description of Artificial Sequence: Synthetic oligonucleotide

SEQ ID NO: 428241 - DNA, 35 bp, Artificial Sequence; identical to SEQ ID NO: 78223
  Description of Artificial Sequence: Synthetic oligonucleotide

SEQ ID NO: 428242 - DNA, 35 bp, Artificial Sequence; identical to SEQ ID NO: 78224
  Description of Artificial Sequence: Synthetic oligonucleotide

SEQ ID NO: 428243 - DNA, 36 bp, Artificial Sequence; identical to SEQ ID NO: 78225
  Description of Artificial Sequence: Synthetic oligonucleotide

SEQ ID NO: 428244 - DNA, 35 bp, Artificial Sequence; identical to SEQ ID NO: 78226
  Description of Artificial Sequence: Synthetic oligonucleotide

SEQ ID NO: 428245 - DNA, 34 bp, Artificial Sequence; identical to SEQ ID NO: 78227
  Description of Artificial Sequence: Synthetic oligonucleotide

SEQ ID NO: 428246 - DNA, 33 bp, Artificial Sequence; identical to SEQ ID NO: 78228
  Description of Artificial Sequence: Synthetic oligonucleotide

SEQ ID NO: 428247 - DNA, 33 bp, Artificial Sequence; identical to SEQ ID NO: 78229
  Description of Artificial Sequence: Synthetic oligonucleotide

SEQ ID NO: 428248 - DNA, 32 bp, Artificial Sequence; identical to SEQ ID NO: 78230
  Description of Artificial Sequence: Synthetic oligonucleotide

SEQ ID NO: 428249 - DNA, 31 bp, Artificial Sequence; identical to SEQ ID NO: 78231
  Description of Artificial Sequence: Synthetic oligonucleotide

SEQ ID NO: 428250 - DNA, 31 bp, Artificial Sequence; identical to SEQ ID NO: 78232
  Description of Artificial Sequence: Synthetic oligonucleotide

SEQ ID NO: 428251 - DNA, 30 bp, Artificial Sequence; identical to SEQ ID NO: 78233
  Description of Artificial Sequence: Synthetic oligonucleotide

SEQ ID NO: 428252 - DNA, 30 bp, Artificial Sequence; identical to SEQ ID NO: 78234
  Description of Artificial Sequence: Synthetic oligonucleotide

SEQ ID NO: 428253 - DNA, 29 bp, Artificial Sequence
  Description of Artificial Sequence: Synthetic oligonucleotide
atgcgtacgatggcaaggattacctcgcc

SEQ ID NO: 428254 - DNA, 28 bp, Artificial Sequence
  Description of Artificial Sequence: Synthetic oligonucleotide
tgcgtacgatggcaaggattacctcgcc

SEQ ID NO: 428255 - DNA, 27 bp, Artificial Sequence
  Description of Artificial Sequence: Synthetic oligonucleotide
gcgtacgatggcaaggattacctcgcc

SEQ ID NO: 428256 - DNA, 27 bp, Artificial Sequence
  Description of Artificial Sequence: Synthetic oligonucleotide
cgtacgatggcaaggattacctcgccc

SEQ ID NO: 428257 - DNA, 28 bp, Artificial Sequence
  Description of Artificial Sequence: Synthetic oligonucleotide
gtacgatggcaaggattacctcgccctg

SEQ ID NO: 428258 - DNA, 25 bp, Artificial Sequence
  Description of Artificial Sequence: Synthetic oligonucleotide
ccggagcccctcatgctgagatgga

SEQ ID NO: 428259 - DNA, 25 bp, Artificial Sequence
  Description of Artificial Sequence: Synthetic oligonucleotide
gtgcggttcgacagcgactcggctt

SEQ ID NO: 428260 - DNA, 26 bp, Artificial Sequence
  Description of Artificial Sequence: Synthetic oligonucleotide
tgcggttcgacagcgactcggcttgt

SEQ ID NO: 428261 - DNA, 25 bp, Artificial Sequence
  Description of Artificial Sequence: Synthetic oligonucleotide
gcggttcgacagcgactcggcttgt

SEQ ID NO: 428262 - DNA, 25 bp, Artificial Sequence
  Description of Artificial Sequence: Synthetic oligonucleotide
cggttcgacagcgactcggcttgtc

SEQ ID NO: 428263 - DNA, 25 bp, Artificial Sequence
  Description of Artificial Sequence: Synthetic oligonucleotide
ggttcgacagcgactcggcttgtcc

SEQ ID NO: 428264 - DNA, 26 bp, Artificial Sequence
  Description of Artificial Sequence: Synthetic oligonucleotide
gttcgacagcgactcggcttgtccga

SEQ ID NO: 428265 - DNA, 26 bp, Artificial Sequence
  Description of Artificial Sequence: Synthetic oligonucleotide
ttcgacagcgactcggcttgtccgag

SEQ ID NO: 428266 - DNA, 25 bp, Artificial Sequence
  Description of Artificial Sequence: Synthetic oligonucleotide
tcgacagcgactcggcttgtccgag

SEQ ID NO: 428267 - DNA, 24 bp, Artificial Sequence
  Description of Artificial Sequence: Synthetic oligonucleotide
cgacagcgactcggcttgtccgag

SEQ ID NO: 428268 - DNA, 26 bp, Artificial Sequence
  Description of Artificial Sequence: Synthetic oligonucleotide
gacagcgactcggcttgtccgaggat

SEQ ID NO: 428269 - DNA, 26 bp, Artificial Sequence
  Description of Artificial Sequence: Synthetic oligonucleotide
acagcgactcggcttgtccgaggatg

SEQ ID NO: 428270 - DNA, 25 bp, Artificial Sequence
  Description of Artificial Sequence: Synthetic oligonucleotide
cagcgactcggcttgtccgaggatg

SEQ ID NO: 428271 - DNA, 26 bp, Artificial Sequence
  Description of Artificial Sequence: Synthetic oligonucleotide
agcgactcggcttgtccgaggatgga

SEQ ID NO: 428272 - DNA, 25 bp, Artificial Sequence
  Description of Artificial Sequence: Synthetic oligonucleotide
gcgactcggcttgtccgaggatgga

SEQ ID NO: 428273 - DNA, 25 bp, Artificial Sequence
  Description of Artificial Sequence: Synthetic oligonucleotide
cgactcggcttgtccgaggatggag

SEQ ID NO: 428274 - DNA, 25 bp, Artificial Sequence
  Description of Artificial Sequence: Synthetic oligonucleotide
gactcggcttgtccgaggatggagc

SEQ ID NO: 428275 - DNA, 25 bp, Artificial Sequence
  Description of Artificial Sequence: Synthetic oligonucleotide
actcggcttgtccgaggatggagcc

SEQ ID NO: 428276 - DNA, 24 bp, Artificial Sequence
  Description of Artificial Sequence: Synthetic oligonucleotide
ctcggcttgtccgaggatggagcc

SEQ ID NO: 428277 - DNA, 24 bp, Artificial Sequence
  Description of Artificial Sequence: Synthetic oligonucleotide
tcggcttgtccgaggatggagccg

SEQ ID NO: 428278 - DNA, 23 bp, Artificial Sequence
  Description of Artificial Sequence: Synthetic oligonucleotide
cggcttgtccgaggatggagccg

SEQ ID NO: 428279 - DNA, 23 bp, Artificial Sequence
  Description of Artificial Sequence: Synthetic oligonucleotide
ggcttgtccgaggatggagccgc

SEQ ID NO: 428280 - DNA, 23 bp, Artificial Sequence
  Description of Artificial Sequence: Synthetic oligonucleotide
gcttgtccgaggatggagccgcg

SEQ ID NO: 428281 - DNA, 23 bp, Artificial Sequence
  Description of Artificial Sequence: Synthetic oligonucleotide
cttgtccgaggatggagccgcgg

SEQ ID NO: 428282 - DNA, 23 bp, Artificial Sequence
  Description of Artificial Sequence: Synthetic oligonucleotide
ttgtccgaggatggagccgcggg

SEQ ID NO: 428283 - DNA, 25 bp, Artificial Sequence
  Description of Artificial Sequence: Synthetic oligonucleotide
ggcacgtgcgtggagtggctccata

SEQ ID NO: 428284 - DNA, 27 bp, Artificial Sequence
  Description of Artificial Sequence: Synthetic oligonucleotide
gcacgtgcgtggagtggctccatagat

SEQ ID NO: 428285 - DNA, 28 bp, Artificial Sequence
  Description of Artificial Sequence: Synthetic oligonucleotide
cacgtgcgtggagtggctccatagatac

SEQ ID NO: 428286 - DNA, 28 bp, Artificial Sequence
  Description of Artificial Sequence: Synthetic oligonucleotide
acgtgcgtggagtggctccatagatacc

SEQ ID NO: 428287 - DNA, 27 bp, Artificial Sequence
  Description of Artificial Sequence: Synthetic oligonucleotide
cgtgcgtggagtggctccatagatacc

SEQ ID NO: 428288 - DNA, 28 bp, Artificial Sequence
  Description of Artificial Sequence: Synthetic oligonucleotide
gtgcgtggagtggctccatagatacctg

SEQ ID NO: 428289 - DNA, 28 bp, Artificial Sequence
  Description of Artificial Sequence: Synthetic oligonucleotide
tgcgtggagtggctccatagatacctgg

SEQ ID NO: 428290 - DNA, 27 bp, Artificial Sequence
  Description of Artificial Sequence: Synthetic oligonucleotide
gcgtggagtggctccatagatacctgg

SEQ ID NO: 428291 - DNA, 28 bp, Artificial Sequence
  Description of Artificial Sequence: Synthetic oligonucleotide
cgtggagtggctccatagatacctggag

SEQ ID NO: 428292 - DNA, 30 bp, Artificial Sequence; identical to SEQ ID NO: 78274
  Description of Artificial Sequence: Synthetic oligonucleotide

SEQ ID NO: 428293 - DNA, 30 bp, Artificial Sequence; identical to SEQ ID NO: 78275
  Description of Artificial Sequence: Synthetic oligonucleotide

SEQ ID NO: 428294 - DNA, 29 bp, Artificial Sequence
  Description of Artificial Sequence: Synthetic oligonucleotide
ggagtggctccatagatacctggagaacg

SEQ ID NO: 428295 - DNA, 29 bp, Artificial Sequence
  Description of Artificial Sequence: Synthetic oligonucleotide
gagtggctccatagatacctggagaacgg

SEQ ID NO: 428296 - DNA, 29 bp, Artificial Sequence
  Description of Artificial Sequence: Synthetic oligonucleotide
agtggctccatagatacctggagaacggg

SEQ ID NO: 428297 - DNA, 28 bp, Artificial Sequence
  Description of Artificial Sequence: Synthetic oligonucleotide
gtggctccatagatacctggagaacggg

SEQ ID NO: 428298 - DNA, 30 bp, Artificial Sequence; identical to SEQ ID NO: 78280
  Description of Artificial Sequence: Synthetic oligonucleotide

SEQ ID NO: 428299 - DNA, 29 bp, Artificial Sequence
  Description of Artificial Sequence: Synthetic oligonucleotide
ggctccatagatacctggagaacgggaag

SEQ ID NO: 428300 - DNA, 29 bp, Artificial Sequence
  Description of Artificial Sequence: Synthetic oligonucleotide
gctccatagatacctggagaacgggaagg

SEQ ID NO: 428301 - DNA, 30 bp, Artificial Sequence; identical to SEQ ID NO: 78283
  Description of Artificial Sequence: Synthetic oligonucleotide

SEQ ID NO: 428302 - DNA, 32 bp, Artificial Sequence; identical to SEQ ID NO: 78284
  Description of Artificial Sequence: Synthetic oligonucleotide

SEQ ID NO: 428303 - DNA, 31 bp, Artificial Sequence; identical to SEQ ID NO: 78285
  Description of Artificial Sequence: Synthetic oligonucleotide

SEQ ID NO: 428304 - DNA, 31 bp, Artificial Sequence; identical to SEQ ID NO: 78286
  Description of Artificial Sequence: Synthetic oligonucleotide

SEQ ID NO: 428305 - DNA, 32 bp, Artificial Sequence; identical to SEQ ID NO: 78287
  Description of Artificial Sequence: Synthetic oligonucleotide

SEQ ID NO: 428306 - DNA, 31 bp, Artificial Sequence; identical to SEQ ID NO: 78288
  Description of Artificial Sequence: Synthetic oligonucleotide

SEQ ID NO: 428307 - DNA, 23 bp, Artificial Sequence
  Description of Artificial Sequence: Synthetic oligonucleotide
gaaggagatgctgcagcgcgcgg

SEQ ID NO: 428308 - DNA, 27 bp, Artificial Sequence
  Description of Artificial Sequence: Synthetic oligonucleotide
cgcagttcgtgcgattcgacagcgact

SEQ ID NO: 428309 - DNA, 27 bp, Artificial Sequence
  Description of Artificial Sequence: Synthetic oligonucleotide
gcagttcgtgcgattcgacagcgactc

SEQ ID NO: 428310 - DNA, 27 bp, Artificial Sequence
  Description of Artificial Sequence: Synthetic oligonucleotide
cagttcgtgcgattcgacagcgactcg

SEQ ID NO: 428311 - DNA, 27 bp, Artificial Sequence
  Description of Artificial Sequence: Synthetic oligonucleotide
agttcgtgcgattcgacagcgactcgg

SEQ ID NO: 428312 - DNA, 26 bp, Artificial Sequence
  Description of Artificial Sequence: Synthetic oligonucleotide
gttcgtgcgattcgacagcgactcgg

SEQ ID NO: 428313 - DNA, 26 bp, Artificial Sequence
  Description of Artificial Sequence: Synthetic oligonucleotide
ttcgtgcgattcgacagcgactcggc

SEQ ID NO: 428314 - DNA, 25 bp, Artificial Sequence
  Description of Artificial Sequence: Synthetic oligonucleotide
tcgtgcgattcgacagcgactcggc

SEQ ID NO: 428315 - DNA, 24 bp, Artificial Sequence
  Description of Artificial Sequence: Synthetic oligonucleotide
cgtgcgattcgacagcgactcggc

SEQ ID NO: 428316 - DNA, 25 bp, Artificial Sequence
  Description of Artificial Sequence: Synthetic oligonucleotide
gtgcgattcgacagcgactcggcgt

SEQ ID NO: 428317 - DNA, 26 bp, Artificial Sequence
  Description of Artificial Sequence: Synthetic oligonucleotide
tgcgattcgacagcgactcggcgtgt

SEQ ID NO: 428318 - DNA, 25 bp, Artificial Sequence
  Description of Artificial Sequence: Synthetic oligonucleotide
gcgattcgacagcgactcggcgtgt

SEQ ID NO: 428319 - DNA, 25 bp, Artificial Sequence
  Description of Artificial Sequence: Synthetic oligonucleotide
cgattcgacagcgactcggcgtgtc

SEQ ID NO: 428320 - DNA, 25 bp, Artificial Sequence
  Description of Artificial Sequence: Synthetic oligonucleotide
gattcgacagcgactcggcgtgtcc

SEQ ID NO: 428321 - DNA, 26 bp, Artificial Sequence
  Description of Artificial Sequence: Synthetic oligonucleotide
attcgacagcgactcggcgtgtccga

SEQ ID NO: 428322 - DNA, 22 bp, Artificial Sequence
  Description of Artificial Sequence: Synthetic oligonucleotide
ggcgccgtgggtggagcaggaa

SEQ ID NO: 428323 - DNA, 22 bp, Artificial Sequence
  Description of Artificial Sequence: Synthetic oligonucleotide
gcgccgtgggtggagcaggaag

SEQ ID NO: 428324 - DNA, 22 bp, Artificial Sequence
  Description of Artificial Sequence: Synthetic oligonucleotide
cgccgtgggtggagcaggaagg

SEQ ID NO: 428325 - DNA, 27 bp, Artificial Sequence
  Description of Artificial Sequence: Synthetic oligonucleotide
gagcaggaagggccggagtattgggaa

SEQ ID NO: 428326 - DNA, 27 bp, Artificial Sequence
  Description of Artificial Sequence: Synthetic oligonucleotide
agcaggaagggccggagtattgggaag

SEQ ID NO: 428327 - DNA, 27 bp, Artificial Sequence
  Description of Artificial Sequence: Synthetic oligonucleotide
gcaggaagggccggagtattgggaaga

SEQ ID NO: 428328 - DNA, 27 bp, Artificial Sequence
  Description of Artificial Sequence: Synthetic oligonucleotide
caggaagggccggagtattgggaagag

SEQ ID NO: 428329 - DNA, 27 bp, Artificial Sequence
  Description of Artificial Sequence: Synthetic oligonucleotide
aggaagggccggagtattgggaagagg

SEQ ID NO: 428330 - DNA, 27 bp, Artificial Sequence
  Description of Artificial Sequence: Synthetic oligonucleotide
ggaagggccggagtattgggaagagga

SEQ ID NO: 428331 - DNA, 27 bp, Artificial Sequence
  Description of Artificial Sequence: Synthetic oligonucleotide
gaagggccggagtattgggaagaggag

SEQ ID NO: 428332 - DNA, 28 bp, Artificial Sequence
  Description of Artificial Sequence: Synthetic oligonucleotide
aagggccggagtattgggaagaggagac

SEQ ID NO: 428333 - DNA, 27 bp, Artificial Sequence
  Description of Artificial Sequence: Synthetic oligonucleotide
agggccggagtattgggaagaggagac

SEQ ID NO: 428334 - DNA, 27 bp, Artificial Sequence
  Description of Artificial Sequence: Synthetic oligonucleotide
cactccatgaggtatttcagcgccgcg

SEQ ID NO: 428335 - DNA, 27 bp, Artificial Sequence
  Description of Artificial Sequence: Synthetic oligonucleotide
actccatgaggtatttcagcgccgcgg

SEQ ID NO: 428336 - DNA, 27 bp, Artificial Sequence
  Description of Artificial Sequence: Synthetic oligonucleotide
ctccatgaggtatttcagcgccgcggt

SEQ ID NO: 428337 - DNA, 27 bp, Artificial Sequence
  Description of Artificial Sequence: Synthetic oligonucleotide
tccatgaggtatttcagcgccgcggtg

SEQ ID NO: 428338 - DNA, 27 bp, Artificial Sequence
  Description of Artificial Sequence: Synthetic oligonucleotide
ccatgaggtatttcagcgccgcggtgt

SEQ ID NO: 428339 - DNA, 27 bp, Artificial Sequence
  Description of Artificial Sequence: Synthetic oligonucleotide
catgaggtatttcagcgccgcggtgtc

SEQ ID NO: 428340 - DNA, 27 bp, Artificial Sequence
  Description of Artificial Sequence: Synthetic oligonucleotide
atgaggtatttcagcgccgcggtgtcc

SEQ ID NO: 428341 - DNA, 26 bp, Artificial Sequence
  Description of Artificial Sequence: Synthetic oligonucleotide
tgaggtatttcagcgccgcggtgtcc

SEQ ID NO: 428342 - DNA, 25 bp, Artificial Sequence
  Description of Artificial Sequence: Synthetic oligonucleotide
gaggtatttcagcgccgcggtgtcc

SEQ ID NO: 428343 - DNA, 25 bp, Artificial Sequence
  Description of Artificial Sequence: Synthetic oligonucleotide
aggtatttcagcgccgcggtgtccc

SEQ ID NO: 428344 - DNA, 24 bp, Artificial Sequence
  Description of Artificial Sequence: Synthetic oligonucleotide
ggtatttcagcgccgcggtgtccc

SEQ ID NO: 428345 - DNA, 24 bp, Artificial Sequence
  Description of Artificial Sequence: Synthetic oligonucleotide
gtatttcagcgccgcggtgtcccg

SEQ ID NO: 428346 - DNA, 24 bp, Artificial Sequence
  Description of Artificial Sequence: Synthetic oligonucleotide
tatttcagcgccgcggtgtcccgg

SEQ ID NO: 428347 - DNA, 23 bp, Artificial Sequence
  Description of Artificial Sequence: Synthetic oligonucleotide
atttcagcgccgcggtgtcccgg

SEQ ID NO: 428348 - DNA, 22 bp, Artificial Sequence
  Description of Artificial Sequence: Synthetic oligonucleotide
tttcagcgccgcggtgtcccgg

SEQ ID NO: 428349 - DNA, 21 bp, Artificial Sequence
  Description of Artificial Sequence: Synthetic oligonucleotide
ttcagcgccgcggtgtcccgg

SEQ ID NO: 428350 - DNA, 20 bp, Artificial Sequence
  Description of Artificial Sequence: Synthetic oligonucleotide
tcagcgccgcggtgtcccgg

SEQ ID NO: 428351 - DNA, 20 bp, Artificial Sequence
  Description of Artificial Sequence: Synthetic oligonucleotide
cagcgccgcggtgtcccggt

SEQ ID NO: 428352 - DNA, 20 bp, Artificial Sequence
  Description of Artificial Sequence: Synthetic oligonucleotide
agcgccgcggtgtcccggct

SEQ ID NO: 428353 - DNA, 20 bp, Artificial Sequence
  Description of Artificial Sequence: Synthetic oligonucleotide
gcgccgcggtgtcccggctt

SEQ ID NO: 428354 - DNA, 20 bp, Artificial Sequence
  Description of Artificial Sequence: Synthetic oligonucleotide
cgccgcggtgtcccggcctt

SEQ ID NO: 428355 - DNA, 20 bp, Artificial Sequence
  Description of Artificial Sequence: Synthetic oligonucleotide
gccgcggtgtcccggccctt

SEQ ID NO: 428356 - DNA, 20 bp, Artificial Sequence
  Description of Artificial Sequence: Synthetic oligonucleotide
ccgcggtgtcccggcccgtt

SEQ ID NO: 428357 - DNA, 20 bp, Artificial Sequence
  Description of Artificial Sequence: Synthetic oligonucleotide
cgcggtgtcccggcccggtt

SEQ ID NO: 428358 - DNA, 20 bp, Artificial Sequence
  Description of Artificial Sequence: Synthetic oligonucleotide
gcggtgtcccggcccggctt

SEQ ID NO: 428359 - DNA, 20 bp, Artificial Sequence
  Description of Artificial Sequence: Synthetic oligonucleotide
cggtgtcccggcccggcctt

SEQ ID NO: 428360 - DNA, 20 bp, Artificial Sequence
  Description of Artificial Sequence: Synthetic oligonucleotide
ggtgtcccggcccggccgtt

SEQ ID NO: 428361 - DNA, 33 bp, Artificial Sequence; identical to SEQ ID NO: 78341
  Description of Artificial Sequence: Synthetic oligonucleotide

SEQ ID NO: 428362 - DNA, 33 bp, Artificial Sequence; identical to SEQ ID NO: 78342
  Description of Artificial Sequence: Synthetic oligonucleotide

SEQ ID NO: 428363 - DNA, 32 bp, Artificial Sequence; identical to SEQ ID NO: 78343
  Description of Artificial Sequence: Synthetic oligonucleotide

SEQ ID NO: 428364 - DNA, 32 bp, Artificial Sequence; identical to SEQ ID NO: 78344
  Description of Artificial Sequence: Synthetic oligonucleotide

SEQ ID NO: 428365 - DNA, 31 bp, Artificial Sequence; identical to SEQ ID NO: 78345
  Description of Artificial Sequence: Synthetic oligonucleotide

SEQ ID NO: 428366 - DNA, 30 bp, Artificial Sequence; identical to SEQ ID NO: 78346
  Description of Artificial Sequence: Synthetic oligonucleotide

SEQ ID NO: 428367 - DNA, 31 bp, Artificial Sequence; identical to SEQ ID NO: 78347
  Description of Artificial Sequence: Synthetic oligonucleotide

SEQ ID NO: 428368 - DNA, 30 bp, Artificial Sequence; identical to SEQ ID NO: 78348
  Description of Artificial Sequence: Synthetic oligonucleotide

SEQ ID NO: 428369 - DNA, 30 bp, Artificial Sequence; identical to SEQ ID NO: 78349
  Description of Artificial Sequence: Synthetic oligonucleotide

SEQ ID NO: 428370 - DNA, 29 bp, Artificial Sequence
  Description of Artificial Sequence: Synthetic oligonucleotide
taccctccagtggatgattggttgcgacc

SEQ ID NO: 428371 - DNA, 28 bp, Artificial Sequence
  Description of Artificial Sequence: Synthetic oligonucleotide
accctccagtggatgattggttgcgacc

SEQ ID NO: 428372 - DNA, 27 bp, Artificial Sequence
  Description of Artificial Sequence: Synthetic oligonucleotide
ccctccagtggatgattggttgcgacc

SEQ ID NO: 428373 - DNA, 28 bp, Artificial Sequence
  Description of Artificial Sequence: Synthetic oligonucleotide
cctccagtggatgattggttgcgacctg

SEQ ID NO: 428374 - DNA, 28 bp, Artificial Sequence
  Description of Artificial Sequence: Synthetic oligonucleotide
ctccagtggatgattggttgcgacctgg

SEQ ID NO: 428375 - DNA, 28 bp, Artificial Sequence
  Description of Artificial Sequence: Synthetic oligonucleotide
tccagtggatgattggttgcgacctggg

SEQ ID NO: 428376 - DNA, 27 bp, Artificial Sequence
  Description of Artificial Sequence: Synthetic oligonucleotide
ccagtggatgattggttgcgacctggg

SEQ ID NO: 428377 - DNA, 27 bp, Artificial Sequence
  Description of Artificial Sequence: Synthetic oligonucleotide
cagtggatgattggttgcgacctgggg

SEQ ID NO: 428378 - DNA, 28 bp, Artificial Sequence
  Description of Artificial Sequence: Synthetic oligonucleotide
agtggatgattggttgcgacctggggtc

SEQ ID NO: 428379 - DNA, 27 bp, Artificial Sequence
  Description of Artificial Sequence: Synthetic oligonucleotide
gtggatgattggttgcgacctggggtc

SEQ ID NO: 428380 - DNA, 27 bp, Artificial Sequence
  Description of Artificial Sequence: Synthetic oligonucleotide
tggatgattggttgcgacctggggtcc

SEQ ID NO: 428381 - DNA, 26 bp, Artificial Sequence
  Description of Artificial Sequence: Synthetic oligonucleotide
ggatgattggttgcgacctggggtcc

SEQ ID NO: 428382 - DNA, 27 bp, Artificial Sequence
  Description of Artificial Sequence: Synthetic oligonucleotide
gatgattggttgcgacctggggtccga

SEQ ID NO: 428383 - DNA, 27 bp, Artificial Sequence
  Description of Artificial Sequence: Synthetic oligonucleotide
atgattggttgcgacctggggtccgac

SEQ ID NO: 428384 - DNA, 26 bp, Artificial Sequence
  Description of Artificial Sequence: Synthetic oligonucleotide
tgattggttgcgacctggggtccgac

SEQ ID NO: 428385 - DNA, 25 bp, Artificial Sequence
  Description of Artificial Sequence: Synthetic oligonucleotide
gattggttgcgacctggggtccgac

SEQ ID NO: 428386 - DNA, 25 bp, Artificial Sequence
  Description of Artificial Sequence: Synthetic oligonucleotide
attggttgcgacctggggtccgacg

SEQ ID NO: 428387 - DNA, 24 bp, Artificial Sequence
  Description of Artificial Sequence: Synthetic oligonucleotide
ttggttgcgacctggggtccgacg

SEQ ID NO: 428388 - DNA, 23 bp, Artificial Sequence
  Description of Artificial Sequence: Synthetic oligonucleotide
tggttgcgacctggggtccgacg

SEQ ID NO: 428389 - DNA, 22 bp, Artificial Sequence
  Description of Artificial Sequence: Synthetic oligonucleotide
ggttgcgacctggggtccgacg

SEQ ID NO: 428390 - DNA, 23 bp, Artificial Sequence
  Description of Artificial Sequence: Synthetic oligonucleotide
gttgcgacctggggtccgacgga

SEQ ID NO: 428391 - DNA, 23 bp, Artificial Sequence
  Description of Artificial Sequence: Synthetic oligonucleotide
ttgcgacctggggtccgacggac

SEQ ID NO: 428392 - DNA, 29 bp, Artificial Sequence
  Description of Artificial Sequence: Synthetic oligonucleotide
cctgggcttctaccctgcagagatcatac

SEQ ID NO: 428393 - DNA, 30 bp, Artificial Sequence; identical to SEQ ID NO: 78373
  Description of Artificial Sequence: Synthetic oligonucleotide

SEQ ID NO: 428394 - DNA, 31 bp, Artificial Sequence; identical to SEQ ID NO: 78374
  Description of Artificial Sequence: Synthetic oligonucleotide

SEQ ID NO: 428395 - DNA, 30 bp, Artificial Sequence; identical to SEQ ID NO: 78375
  Description of Artificial Sequence: Synthetic oligonucleotide

SEQ ID NO: 428396 - DNA, 30 bp, Artificial Sequence; identical to SEQ ID NO: 78376
  Description of Artificial Sequence: Synthetic oligonucleotide

SEQ ID NO: 428397 - DNA, 31 bp, Artificial Sequence; identical to SEQ ID NO: 78377
  Description of Artificial Sequence: Synthetic oligonucleotide

SEQ ID NO: 428398 - DNA, 31 bp, Artificial Sequence; identical to SEQ ID NO: 78378
  Description of Artificial Sequence: Synthetic oligonucleotide

SEQ ID NO: 428399 - DNA, 31 bp, Artificial Sequence; identical to SEQ ID NO: 78379
  Description of Artificial Sequence: Synthetic oligonucleotide

SEQ ID NO: 428400 - DNA, 30 bp, Artificial Sequence; identical to SEQ ID NO: 78380
  Description of Artificial Sequence: Synthetic oligonucleotide

SEQ ID NO: 428401 - DNA, 29 bp, Artificial Sequence
  Description of Artificial Sequence: Synthetic oligonucleotide
ctaccctgcagagatcatactgacctggc

SEQ ID NO: 428402 - DNA, 30 bp, Artificial Sequence; identical to SEQ ID NO: 78382
  Description of Artificial Sequence: Synthetic oligonucleotide

SEQ ID NO: 428403 - DNA, 29 bp, Artificial Sequence
  Description of Artificial Sequence: Synthetic oligonucleotide
accctgcagagatcatactgacctggcag

SEQ ID NO: 428404 - DNA, 28 bp, Artificial Sequence
  Description of Artificial Sequence: Synthetic oligonucleotide
ccctgcagagatcatactgacctggcag

SEQ ID NO: 428405 - DNA, 28 bp, Artificial Sequence
  Description of Artificial Sequence: Synthetic oligonucleotide
cctgcagagatcatactgacctggcagc

SEQ ID NO: 428406 - DNA, 28 bp, Artificial Sequence
  Description of Artificial Sequence: Synthetic oligonucleotide
ctgcagagatcatactgacctggcagcg

SEQ ID NO: 428407 - DNA, 28 bp, Artificial Sequence
  Description of Artificial Sequence: Synthetic oligonucleotide
tgcagagatcatactgacctggcagcgg

SEQ ID NO: 428408 - DNA, 27 bp, Artificial Sequence
  Description of Artificial Sequence: Synthetic oligonucleotide
gcagagatcatactgacctggcagcgg

SEQ ID NO: 428409 - DNA, 27 bp, Artificial Sequence
  Description of Artificial Sequence: Synthetic oligonucleotide
cagagatcatactgacctggcagcggg

SEQ ID NO: 428410 - DNA, 29 bp, Artificial Sequence
  Description of Artificial Sequence: Synthetic oligonucleotide
agagatcatactgacctggcagcgggatg

SEQ ID NO: 428411 - DNA, 31 bp, Artificial Sequence; identical to SEQ ID NO: 78391
  Description of Artificial Sequence: Synthetic oligonucleotide

SEQ ID NO: 428412 - DNA, 30 bp, Artificial Sequence; identical to SEQ ID NO: 78392
  Description of Artificial Sequence: Synthetic oligonucleotide

SEQ ID NO: 428413 - DNA, 30 bp, Artificial Sequence; identical to SEQ ID NO: 78393
  Description of Artificial Sequence: Synthetic oligonucleotide

SEQ ID NO: 428414 - DNA, 31 bp, Artificial Sequence; identical to SEQ ID NO: 78394
  Description of Artificial Sequence: Synthetic oligonucleotide

SEQ ID NO: 428415 - DNA, 30 bp, Artificial Sequence; identical to SEQ ID NO: 78395
  Description of Artificial Sequence: Synthetic oligonucleotide

SEQ ID NO: 428416 - DNA, 30 bp, Artificial Sequence; identical to SEQ ID NO: 78396
  Description of Artificial Sequence: Synthetic oligonucleotide

SEQ ID NO: 428417 - DNA, 29 bp, Artificial Sequence
  Description of Artificial Sequence: Synthetic oligonucleotide
ggagcagagatacacatgccatgtgcagc

SEQ ID NO: 428418 - DNA, 20 bp, Artificial Sequence
  Description of Artificial Sequence: Synthetic oligonucleotide
cgggcgccgtgggtggagct

SEQ ID NO: 428419 - DNA, 20 bp, Artificial Sequence
  Description of Artificial Sequence: Synthetic oligonucleotide
gggcgccgtgggtggagcgt

SEQ ID NO: 428420 - DNA, 20 bp, Artificial Sequence
  Description of Artificial Sequence: Synthetic oligonucleotide
ggcgccgtgggtggagcggt

SEQ ID NO: 428421 - DNA, 20 bp, Artificial Sequence
  Description of Artificial Sequence: Synthetic oligonucleotide
gcgccgtgggtggagcggga

SEQ ID NO: 428422 - DNA, 20 bp, Artificial Sequence
  Description of Artificial Sequence: Synthetic oligonucleotide
cgccgtgggtggagcgggag

SEQ ID NO: 428423 - DNA, 20 bp, Artificial Sequence
  Description of Artificial Sequence: Synthetic oligonucleotide
gccgtgggtggagcgggagg

SEQ ID NO: 428424 - DNA, 20 bp, Artificial Sequence
  Description of Artificial Sequence: Synthetic oligonucleotide
ccgtgggtggagcgggaggg

SEQ ID NO: 428425 - DNA, 20 bp, Artificial Sequence
  Description of Artificial Sequence: Synthetic oligonucleotide
cgtgggtggagcgggagggg

SEQ ID NO: 428426 - DNA, 20 bp, Artificial Sequence
  Description of Artificial Sequence: Synthetic oligonucleotide
gtgggtggagcgggaggggc

SEQ ID NO: 428427 - DNA, 20 bp, Artificial Sequence
  Description of Artificial Sequence: Synthetic oligonucleotide
tgggtggagcgggaggggcc

SEQ ID NO: 428428 - DNA, 20 bp, Artificial Sequence
  Description of Artificial Sequence: Synthetic oligonucleotide
gggtggagcgggaggggcct

SEQ ID NO: 428429 - DNA, 20 bp, Artificial Sequence
  Description of Artificial Sequence: Synthetic oligonucleotide
ggtggagcgggaggggccgt

SEQ ID NO: 428430 - DNA, 20 bp, Artificial Sequence
  Description of Artificial Sequence: Synthetic oligonucleotide
gtggagcgggaggggccgga

SEQ ID NO: 428431 - DNA, 24 bp, Artificial Sequence
  Description of Artificial Sequence: Synthetic oligonucleotide
tggagcgggaggggccggagtatt

SEQ ID NO: 428432 - DNA, 23 bp, Artificial Sequence
  Description of Artificial Sequence: Synthetic oligonucleotide
ggagcgggaggggccggagtatt

SEQ ID NO: 428433 - DNA, 24 bp, Artificial Sequence
  Description of Artificial Sequence: Synthetic oligonucleotide
cgggaggggccggagtattgggaa

SEQ ID NO: 428434 - DNA, 25 bp, Artificial Sequence
  Description of Artificial Sequence: Synthetic oligonucleotide
gggaggggccggagtattgggaaga

SEQ ID NO: 428435 - DNA, 23 bp, Artificial Sequence
  Description of Artificial Sequence: Synthetic oligonucleotide
gagctcgtggagaccaggcctgc

SEQ ID NO: 428436 - DNA, 23 bp, Artificial Sequence
  Description of Artificial Sequence: Synthetic oligonucleotide
agctcgtggagaccaggcctgcc

SEQ ID NO: 428437 - DNA, 22 bp, Artificial Sequence
  Description of Artificial Sequence: Synthetic oligonucleotide
gctcgtggagaccaggcctgcc

SEQ ID NO: 428438 - DNA, 22 bp, Artificial Sequence
  Description of Artificial Sequence: Synthetic oligonucleotide
ctcgtggagaccaggcctgccg

SEQ ID NO: 428439 - DNA, 22 bp, Artificial Sequence
  Description of Artificial Sequence: Synthetic oligonucleotide
tcgtggagaccaggcctgccgg

SEQ ID NO: 428440 - DNA, 21 bp, Artificial Sequence
  Description of Artificial Sequence: Synthetic oligonucleotide
cgtggagaccaggcctgccgg

SEQ ID NO: 428441 - DNA, 27 bp, Artificial Sequence
  Description of Artificial Sequence: Synthetic oligonucleotide
tcatcgccatgggctacgtggacgact

SEQ ID NO: 428442 - DNA, 26 bp, Artificial Sequence
  Description of Artificial Sequence: Synthetic oligonucleotide
catcgccatgggctacgtggacgact

SEQ ID NO: 428443 - DNA, 26 bp, Artificial Sequence
  Description of Artificial Sequence: Synthetic oligonucleotide
atcgccatgggctacgtggacgactc

SEQ ID NO: 428444 - DNA, 25 bp, Artificial Sequence
  Description of Artificial Sequence: Synthetic oligonucleotide
tcgccatgggctacgtggacgactc

SEQ ID NO: 428445 - DNA, 24 bp, Artificial Sequence
  Description of Artificial Sequence: Synthetic oligonucleotide
cgccatgggctacgtggacgactc

SEQ ID NO: 428446 - DNA, 24 bp, Artificial Sequence
  Description of Artificial Sequence: Synthetic oligonucleotide
gccatgggctacgtggacgactcg

SEQ ID NO: 428447 - DNA, 25 bp, Artificial Sequence
  Description of Artificial Sequence: Synthetic oligonucleotide
ccatgggctacgtggacgactcgca

SEQ ID NO: 428448 - DNA, 27 bp, Artificial Sequence
  Description of Artificial Sequence: Synthetic oligonucleotide
catgggctacgtggacgactcgcagtt

SEQ ID NO: 428449 - DNA, 27 bp, Artificial Sequence
  Description of Artificial Sequence: Synthetic oligonucleotide
atgggctacgtggacgactcgcagttc

SEQ ID NO: 428450 - DNA, 26 bp, Artificial Sequence
  Description of Artificial Sequence: Synthetic oligonucleotide
ctacgtggacgactcgcagttcgtgc

SEQ ID NO: 428451 - DNA, 26 bp, Artificial Sequence
  Description of Artificial Sequence: Synthetic oligonucleotide
tacgtggacgactcgcagttcgtgcg

SEQ ID NO: 428452 - DNA, 25 bp, Artificial Sequence
  Description of Artificial Sequence: Synthetic oligonucleotide
acgtggacgactcgcagttcgtgcg

SEQ ID NO: 428453 - DNA, 24 bp, Artificial Sequence
  Description of Artificial Sequence: Synthetic oligonucleotide
cgtggacgactcgcagttcgtgcg

SEQ ID NO: 428454 - DNA, 26 bp, Artificial Sequence
  Description of Artificial Sequence: Synthetic oligonucleotide
gtggacgactcgcagttcgtgcggtt

SEQ ID NO: 428455 - DNA, 26 bp, Artificial Sequence
  Description of Artificial Sequence: Synthetic oligonucleotide
tggacgactcgcagttcgtgcggttc

SEQ ID NO: 428456 - DNA, 25 bp, Artificial Sequence
  Description of Artificial Sequence: Synthetic oligonucleotide
ggacgactcgcagttcgtgcggttc

SEQ ID NO: 428457 - DNA, 26 bp, Artificial Sequence
  Description of Artificial Sequence: Synthetic oligonucleotide
gacgactcgcagttcgtgcggttcga

SEQ ID NO: 428458 - DNA, 27 bp, Artificial Sequence
  Description of Artificial Sequence: Synthetic oligonucleotide
acgactcgcagttcgtgcggttcgaca

SEQ ID NO: 428459 - DNA, 26 bp, Artificial Sequence
  Description of Artificial Sequence: Synthetic oligonucleotide
cgactcgcagttcgtgcggttcgaca

SEQ ID NO: 428460 - DNA, 26 bp, Artificial Sequence
  Description of Artificial Sequence: Synthetic oligonucleotide
gactcgcagttcgtgcggttcgacag

SEQ ID NO: 428461 - DNA, 26 bp, Artificial Sequence
  Description of Artificial Sequence: Synthetic oligonucleotide
actcgcagttcgtgcggttcgacagc

SEQ ID NO: 428462 - DNA, 25 bp, Artificial Sequence
  Description of Artificial Sequence: Synthetic oligonucleotide
ctcgcagttcgtgcggttcgacagc

SEQ ID NO: 428463 - DNA, 26 bp, Artificial Sequence
  Description of Artificial Sequence: Synthetic oligonucleotide
tcgcagttcgtgcggttcgacagcga

SEQ ID NO: 428464 - DNA, 23 bp, Artificial Sequence
  Description of Artificial Sequence: Synthetic oligonucleotide
ctggggtccgacggacgcctcat

SEQ ID NO: 428465 - DNA, 23 bp, Artificial Sequence
  Description of Artificial Sequence: Synthetic oligonucleotide
tggggtccgacggacgcctcatc

SEQ ID NO: 428466 - DNA, 22 bp, Artificial Sequence
  Description of Artificial Sequence: Synthetic oligonucleotide
ggggtccgacggacgcctcatc

SEQ ID NO: 428467 - DNA, 22 bp, Artificial Sequence
  Description of Artificial Sequence: Synthetic oligonucleotide
gggtccgacggacgcctcatcc

SEQ ID NO: 428468 - DNA, 22 bp, Artificial Sequence
  Description of Artificial Sequence: Synthetic oligonucleotide
ggtccgacggacgcctcatccg

SEQ ID NO: 428469 - DNA, 22 bp, Artificial Sequence
  Description of Artificial Sequence: Synthetic oligonucleotide
gtccgacggacgcctcatccgc

SEQ ID NO: 428470 - DNA, 22 bp, Artificial Sequence
  Description of Artificial Sequence: Synthetic oligonucleotide
tccgacggacgcctcatccgcg

SEQ ID NO: 428471 - DNA, 21 bp, Artificial Sequence
  Description of Artificial Sequence: Synthetic oligonucleotide
ccgacggacgcctcatccgcg

SEQ ID NO: 428472 - DNA, 21 bp, Artificial Sequence
  Description of Artificial Sequence: Synthetic oligonucleotide
cgacggacgcctcatccgcgg

SEQ ID NO: 428473 - DNA, 24 bp, Artificial Sequence
  Description of Artificial Sequence: Synthetic oligonucleotide
gacggacgcctcatccgcgggtat

SEQ ID NO: 428474 - DNA, 26 bp, Artificial Sequence
  Description of Artificial Sequence: Synthetic oligonucleotide
acggacgcctcatccgcgggtatgaa

SEQ ID NO: 428475 - DNA, 25 bp, Artificial Sequence
  Description of Artificial Sequence: Synthetic oligonucleotide
cggacgcctcatccgcgggtatgaa

SEQ ID NO: 428476 - DNA, 26 bp, Artificial Sequence
  Description of Artificial Sequence: Synthetic oligonucleotide
ggacgcctcatccgcgggtatgaaca

SEQ ID NO: 428477 - DNA, 27 bp, Artificial Sequence
  Description of Artificial Sequence: Synthetic oligonucleotide
gacgcctcatccgcgggtatgaacagt

SEQ ID NO: 428478 - DNA, 29 bp, Artificial Sequence
  Description of Artificial Sequence: Synthetic oligonucleotide
acgcctcatccgcgggtatgaacagtatg

SEQ ID NO: 428479 - DNA, 28 bp, Artificial Sequence
  Description of Artificial Sequence: Synthetic oligonucleotide
cgcctcatccgcgggtatgaacagtatg

SEQ ID NO: 428480 - DNA, 28 bp, Artificial Sequence
  Description of Artificial Sequence: Synthetic oligonucleotide
gcctcatccgcgggtatgaacagtatgc

SEQ ID NO: 428481 - DNA, 28 bp, Artificial Sequence
  Description of Artificial Sequence: Synthetic oligonucleotide
cctcatccgcgggtatgaacagtatgcc

SEQ ID NO: 428482 - DNA, 30 bp, Artificial Sequence; identical to SEQ ID NO: 78464
  Description of Artificial Sequence: Synthetic oligonucleotide

SEQ ID NO: 428483 - DNA, 30 bp, Artificial Sequence; identical to SEQ ID NO: 78465
  Description of Artificial Sequence: Synthetic oligonucleotide

SEQ ID NO: 428484 - DNA, 29 bp, Artificial Sequence
  Description of Artificial Sequence: Synthetic oligonucleotide
catccgcgggtatgaacagtatgcctacg

SEQ ID NO: 428485 - DNA, 31 bp, Artificial Sequence; identical to SEQ ID NO: 78467
  Description of Artificial Sequence: Synthetic oligonucleotide

SEQ ID NO: 428486 - DNA, 26 bp, Artificial Sequence
  Description of Artificial Sequence: Synthetic oligonucleotide
agcaggaggggcccgagtattgggaa

SEQ ID NO: 428487 - DNA, 25 bp, Artificial Sequence
  Description of Artificial Sequence: Synthetic oligonucleotide
gcaggaggggcccgagtattgggaa

SEQ ID NO: 428488 - DNA, 26 bp, Artificial Sequence
  Description of Artificial Sequence: Synthetic oligonucleotide
caggaggggcccgagtattgggaaga

SEQ ID NO: 428489 - DNA, 26 bp, Artificial Sequence
  Description of Artificial Sequence: Synthetic oligonucleotide
aggaggggcccgagtattgggaagag

SEQ ID NO: 428490 - DNA, 25 bp, Artificial Sequence
  Description of Artificial Sequence: Synthetic oligonucleotide
ggaggggcccgagtattgggaagag

SEQ ID NO: 428491 - DNA, 26 bp, Artificial Sequence
  Description of Artificial Sequence: Synthetic oligonucleotide
gaggggcccgagtattgggaagagga

SEQ ID NO: 428492 - DNA, 27 bp, Artificial Sequence
  Description of Artificial Sequence: Synthetic oligonucleotide
aggggcccgagtattgggaagaggaga

SEQ ID NO: 428493 - DNA, 26 bp, Artificial Sequence
  Description of Artificial Sequence: Synthetic oligonucleotide
ggggcccgagtattgggaagaggaga

SEQ ID NO: 428494 - DNA, 27 bp, Artificial Sequence
  Description of Artificial Sequence: Synthetic oligonucleotide
gggcccgagtattgggaagaggagaca

SEQ ID NO: 428495 - DNA, 27 bp, Artificial Sequence
  Description of Artificial Sequence: Synthetic oligonucleotide
ggcccgagtattgggaagaggagacac

SEQ ID NO: 428496 - DNA, 27 bp, Artificial Sequence
  Description of Artificial Sequence: Synthetic oligonucleotide
gcccgagtattgggaagaggagacacg

SEQ ID NO: 428497 - DNA, 27 bp, Artificial Sequence
  Description of Artificial Sequence: Synthetic oligonucleotide
cccgagtattgggaagaggagacacgg

SEQ ID NO: 428498 - DNA, 29 bp, Artificial Sequence
  Description of Artificial Sequence: Synthetic oligonucleotide
ccgagtattgggaagaggagacacggaac

SEQ ID NO: 428499 - DNA, 30 bp, Artificial Sequence; identical to SEQ ID NO: 78481
  Description of Artificial Sequence: Synthetic oligonucleotide

SEQ ID NO: 428500 - DNA, 25 bp, Artificial Sequence
  Description of Artificial Sequence: Synthetic oligonucleotide
atgaggggctgccagagcccctcat

SEQ ID NO: 428501 - DNA, 24 bp, Artificial Sequence
  Description of Artificial Sequence: Synthetic oligonucleotide
tgaggggctgccagagcccctcat

SEQ ID NO: 428502 - DNA, 23 bp, Artificial Sequence
  Description of Artificial Sequence: Synthetic oligonucleotide
gaggggctgccagagcccctcat

SEQ ID NO: 428503 - DNA, 23 bp, Artificial Sequence
  Description of Artificial Sequence: Synthetic oligonucleotide
aggggctgccagagcccctcatg

SEQ ID NO: 428504 - DNA, 22 bp, Artificial Sequence
  Description of Artificial Sequence: Synthetic oligonucleotide
ggggctgccagagcccctcatg

SEQ ID NO: 428505 - DNA, 23 bp, Artificial Sequence
  Description of Artificial Sequence: Synthetic oligonucleotide
gggctgccagagcccctcatgct

SEQ ID NO: 428506 - DNA, 24 bp, Artificial Sequence
  Description of Artificial Sequence: Synthetic oligonucleotide
ggctgccagagcccctcatgctga

SEQ ID NO: 428507 - DNA, 26 bp, Artificial Sequence
  Description of Artificial Sequence: Synthetic oligonucleotide
gctgccagagcccctcatgctgagat

SEQ ID NO: 428508 - DNA, 26 bp, Artificial Sequence
  Description of Artificial Sequence: Synthetic oligonucleotide
ctgccagagcccctcatgctgagatg

SEQ ID NO: 428509 - DNA, 27 bp, Artificial Sequence
  Description of Artificial Sequence: Synthetic oligonucleotide
tgccagagcccctcatgctgagatgga

SEQ ID NO: 428510 - DNA, 27 bp, Artificial Sequence
  Description of Artificial Sequence: Synthetic oligonucleotide
gccagagcccctcatgctgagatggaa

SEQ ID NO: 428511 - DNA, 27 bp, Artificial Sequence
  Description of Artificial Sequence: Synthetic oligonucleotide
ccagagcccctcatgctgagatggaag

SEQ ID NO: 428512 - DNA, 27 bp, Artificial Sequence
  Description of Artificial Sequence: Synthetic oligonucleotide
cagagcccctcatgctgagatggaagc

SEQ ID NO: 428513 - DNA, 28 bp, Artificial Sequence
  Description of Artificial Sequence: Synthetic oligonucleotide
agagcccctcatgctgagatggaagcag

SEQ ID NO: 428514 - DNA, 27 bp, Artificial Sequence
  Description of Artificial Sequence: Synthetic oligonucleotide
ccatgggctacgtggacgacacgcaat

SEQ ID NO: 428515 - DNA, 28 bp, Artificial Sequence
  Description of Artificial Sequence: Synthetic oligonucleotide
catgggctacgtggacgacacgcaattc

SEQ ID NO: 428516 - DNA, 28 bp, Artificial Sequence
  Description of Artificial Sequence: Synthetic oligonucleotide
atgggctacgtggacgacacgcaattcg

SEQ ID NO: 428517 - DNA, 27 bp, Artificial Sequence
  Description of Artificial Sequence: Synthetic oligonucleotide
cgcaattcgtgcggttcgacagcgact

SEQ ID NO: 428518 - DNA, 27 bp, Artificial Sequence
  Description of Artificial Sequence: Synthetic oligonucleotide
gcaattcgtgcggttcgacagcgactc

SEQ ID NO: 428519 - DNA, 27 bp, Artificial Sequence
  Description of Artificial Sequence: Synthetic oligonucleotide
caattcgtgcggttcgacagcgactcg

SEQ ID NO: 428520 - DNA, 27 bp, Artificial Sequence
  Description of Artificial Sequence: Synthetic oligonucleotide
aattcgtgcggttcgacagcgactcgg

SEQ ID NO: 428521 - DNA, 26 bp, Artificial Sequence
  Description of Artificial Sequence: Synthetic oligonucleotide
attcgtgcggttcgacagcgactcgg

SEQ ID NO: 428522 - DNA, 30 bp, Artificial Sequence; identical to SEQ ID NO: 78530
  Description of Artificial Sequence: Synthetic oligonucleotide

SEQ ID NO: 428523 - DNA, 31 bp, Artificial Sequence; identical to SEQ ID NO: 78531
  Description of Artificial Sequence: Synthetic oligonucleotide

SEQ ID NO: 428524 - DNA, 30 bp, Artificial Sequence; identical to SEQ ID NO: 78532
  Description of Artificial Sequence: Synthetic oligonucleotide

SEQ ID NO: 428525 - DNA, 30 bp, Artificial Sequence; identical to SEQ ID NO: 78533
  Description of Artificial Sequence: Synthetic oligonucleotide

SEQ ID NO: 428526 - DNA, 30 bp, Artificial Sequence; identical to SEQ ID NO: 78534
  Description of Artificial Sequence: Synthetic oligonucleotide

SEQ ID NO: 428527 - DNA, 32 bp, Artificial Sequence; identical to SEQ ID NO: 78535
  Description of Artificial Sequence: Synthetic oligonucleotide

SEQ ID NO: 428528 - DNA, 31 bp, Artificial Sequence; identical to SEQ ID NO: 78536
  Description of Artificial Sequence: Synthetic oligonucleotide

SEQ ID NO: 428529 - DNA, 30 bp, Artificial Sequence; identical to SEQ ID NO: 78537
  Description of Artificial Sequence: Synthetic oligonucleotide

SEQ ID NO: 428530 - DNA, 31 bp, Artificial Sequence; identical to SEQ ID NO: 78538
  Description of Artificial Sequence: Synthetic oligonucleotide

SEQ ID NO: 428531 - DNA, 30 bp, Artificial Sequence; identical to SEQ ID NO: 78539
  Description of Artificial Sequence: Synthetic oligonucleotide

SEQ ID NO: 428532 - DNA, 30 bp, Artificial Sequence; identical to SEQ ID NO: 78540
  Description of Artificial Sequence: Synthetic oligonucleotide

SEQ ID NO: 428533 - DNA, 31 bp, Artificial Sequence; identical to SEQ ID NO: 78541
  Description of Artificial Sequence: Synthetic oligonucleotide

SEQ ID NO: 428534 - DNA, 30 bp, Artificial Sequence; identical to SEQ ID NO: 78542
  Description of Artificial Sequence: Synthetic oligonucleotide

SEQ ID NO: 428535 - DNA, 30 bp, Artificial Sequence; identical to SEQ ID NO: 78543
  Description of Artificial Sequence: Synthetic oligonucleotide

SEQ ID NO: 428536 - DNA, 29 bp, Artificial Sequence
  Description of Artificial Sequence: Synthetic oligonucleotide
ggagcagagatacatgtgccatgtgcagc

SEQ ID NO: 428537 - DNA, 31 bp, Artificial Sequence; identical to SEQ ID NO: 78545
  Description of Artificial Sequence: Synthetic oligonucleotide

SEQ ID NO: 428538 - DNA, 32 bp, Artificial Sequence; identical to SEQ ID NO: 78546
  Description of Artificial Sequence: Synthetic oligonucleotide

SEQ ID NO: 428539 - DNA, 31 bp, Artificial Sequence; identical to SEQ ID NO: 78547
  Description of Artificial Sequence: Synthetic oligonucleotide

SEQ ID NO: 428540 - DNA, 31 bp, Artificial Sequence; identical to SEQ ID NO: 78548
  Description of Artificial Sequence: Synthetic oligonucleotide

SEQ ID NO: 428541 - DNA, 31 bp, Artificial Sequence; identical to SEQ ID NO: 78549
  Description of Artificial Sequence: Synthetic oligonucleotide

SEQ ID NO: 428542 - DNA, 30 bp, Artificial Sequence; identical to SEQ ID NO: 78550
  Description of Artificial Sequence: Synthetic oligonucleotide

SEQ ID NO: 428543 - DNA, 30 bp, Artificial Sequence; identical to SEQ ID NO: 78551
  Description of Artificial Sequence: Synthetic oligonucleotide

SEQ ID NO: 428544 - DNA, 29 bp, Artificial Sequence
  Description of Artificial Sequence: Synthetic oligonucleotide
gatacatgtgccatgtgcagcatgagggg

SEQ ID NO: 428545 - DNA, 29 bp, Artificial Sequence
  Description of Artificial Sequence: Synthetic oligonucleotide
atacatgtgccatgtgcagcatgaggggc

SEQ ID NO: 428546 - DNA, 28 bp, Artificial Sequence
  Description of Artificial Sequence: Synthetic oligonucleotide
tacatgtgccatgtgcagcatgaggggc

SEQ ID NO: 428547 - DNA, 27 bp, Artificial Sequence
  Description of Artificial Sequence: Synthetic oligonucleotide
acatgtgccatgtgcagcatgaggggc

SEQ ID NO: 428548 - DNA, 27 bp, Artificial Sequence
  Description of Artificial Sequence: Synthetic oligonucleotide
catgtgccatgtgcagcatgaggggct

SEQ ID NO: 428549 - DNA, 27 bp, Artificial Sequence
  Description of Artificial Sequence: Synthetic oligonucleotide
atgtgccatgtgcagcatgaggggctg

SEQ ID NO: 428550 - DNA, 26 bp, Artificial Sequence
  Description of Artificial Sequence: Synthetic oligonucleotide
tgtgccatgtgcagcatgaggggctg

SEQ ID NO: 428551 - DNA, 28 bp, Artificial Sequence
  Description of Artificial Sequence: Synthetic oligonucleotide
catgaggtatttcagcgccgccgtgttc

SEQ ID NO: 428552 - DNA, 28 bp, Artificial Sequence
  Description of Artificial Sequence: Synthetic oligonucleotide
atgaggtatttcagcgccgccgtgttcc

SEQ ID NO: 428553 - DNA, 27 bp, Artificial Sequence
  Description of Artificial Sequence: Synthetic oligonucleotide
tgaggtatttcagcgccgccgtgttcc

SEQ ID NO: 428554 - DNA, 26 bp, Artificial Sequence
  Description of Artificial Sequence: Synthetic oligonucleotide
gaggtatttcagcgccgccgtgttcc

SEQ ID NO: 428555 - DNA, 26 bp, Artificial Sequence
  Description of Artificial Sequence: Synthetic oligonucleotide
aggtatttcagcgccgccgtgttccg

SEQ ID NO: 428556 - DNA, 25 bp, Artificial Sequence
  Description of Artificial Sequence: Synthetic oligonucleotide
ggtatttcagcgccgccgtgttccg

SEQ ID NO: 428557 - DNA, 25 bp, Artificial Sequence
  Description of Artificial Sequence: Synthetic oligonucleotide
gtatttcagcgccgccgtgttccgg

SEQ ID NO: 428558 - DNA, 25 bp, Artificial Sequence
  Description of Artificial Sequence: Synthetic oligonucleotide
tatttcagcgccgccgtgttccggc

SEQ ID NO: 428559 - DNA, 24 bp, Artificial Sequence
  Description of Artificial Sequence: Synthetic oligonucleotide
atttcagcgccgccgtgttccggc

SEQ ID NO: 428560 - DNA, 23 bp, Artificial Sequence
  Description of Artificial Sequence: Synthetic oligonucleotide
tttcagcgccgccgtgttccggc

SEQ ID NO: 428561 - DNA, 22 bp, Artificial Sequence
  Description of Artificial Sequence: Synthetic oligonucleotide
ttcagcgccgccgtgttccggc

SEQ ID NO: 428562 - DNA, 21 bp, Artificial Sequence
  Description of Artificial Sequence: Synthetic oligonucleotide
tcagcgccgccgtgttccggc

SEQ ID NO: 428563 - DNA, 20 bp, Artificial Sequence
  Description of Artificial Sequence: Synthetic oligonucleotide
cagcgccgccgtgttccggc

SEQ ID NO: 428564 - DNA, 20 bp, Artificial Sequence
  Description of Artificial Sequence: Synthetic oligonucleotide
agcgccgccgtgttccggcc

SEQ ID NO: 428565 - DNA, 20 bp, Artificial Sequence
  Description of Artificial Sequence: Synthetic oligonucleotide
gcgccgccgtgttccggcct

SEQ ID NO: 428566 - DNA, 20 bp, Artificial Sequence
  Description of Artificial Sequence: Synthetic oligonucleotide
cgccgccgtgttccggccct

SEQ ID NO: 428567 - DNA, 20 bp, Artificial Sequence
  Description of Artificial Sequence: Synthetic oligonucleotide
gccgccgtgttccggcccgt

SEQ ID NO: 428568 - DNA, 20 bp, Artificial Sequence
  Description of Artificial Sequence: Synthetic oligonucleotide
ccgccgtgttccggcccggt

SEQ ID NO: 428569 - DNA, 20 bp, Artificial Sequence
  Description of Artificial Sequence: Synthetic oligonucleotide
cgccgtgttccggcccggct

SEQ ID NO: 428570 - DNA, 20 bp, Artificial Sequence
  Description of Artificial Sequence: Synthetic oligonucleotide
gccgtgttccggcccggcct

SEQ ID NO: 428571 - DNA, 20 bp, Artificial Sequence
  Description of Artificial Sequence: Synthetic oligonucleotide
ccgtgttccggcccggccgt

SEQ ID NO: 428572 - DNA, 20 bp, Artificial Sequence
  Description of Artificial Sequence: Synthetic oligonucleotide
cgtgttccggcccggccgct

SEQ ID NO: 428573 - DNA, 20 bp, Artificial Sequence
  Description of Artificial Sequence: Synthetic oligonucleotide
gtgttccggcccggccgcgt

SEQ ID NO: 428574 - DNA, 20 bp, Artificial Sequence
  Description of Artificial Sequence: Synthetic oligonucleotide
tgttccggcccggccgcggt

SEQ ID NO: 428575 - DNA, 20 bp, Artificial Sequence
  Description of Artificial Sequence: Synthetic oligonucleotide
gttccggcccggccgcggtt

SEQ ID NO: 428576 - DNA, 20 bp, Artificial Sequence
  Description of Artificial Sequence: Synthetic oligonucleotide
ttccggcccggccgcgggtt

SEQ ID NO: 428577 - DNA, 20 bp, Artificial Sequence
  Description of Artificial Sequence: Synthetic oligonucleotide
tccggcccggccgcgggttt

SEQ ID NO: 428578 - DNA, 28 bp, Artificial Sequence
  Description of Artificial Sequence: Synthetic oligonucleotide
ctgcggagatcatactgacctggcagtg

SEQ ID NO: 428579 - DNA, 28 bp, Artificial Sequence
  Description of Artificial Sequence: Synthetic oligonucleotide
tgcggagatcatactgacctggcagtgg

SEQ ID NO: 428580 - DNA, 27 bp, Artificial Sequence
  Description of Artificial Sequence: Synthetic oligonucleotide
gcggagatcatactgacctggcagtgg

SEQ ID NO: 428581 - DNA, 27 bp, Artificial Sequence
  Description of Artificial Sequence: Synthetic oligonucleotide
cggagatcatactgacctggcagtggg

SEQ ID NO: 428582 - DNA, 29 bp, Artificial Sequence
  Description of Artificial Sequence: Synthetic oligonucleotide
ggagatcatactgacctggcagtgggatg

SEQ ID NO: 428583 - DNA, 29 bp, Artificial Sequence
  Description of Artificial Sequence: Synthetic oligonucleotide
gagatcatactgacctggcagtgggatgg

SEQ ID NO: 428584 - DNA, 29 bp, Artificial Sequence
  Description of Artificial Sequence: Synthetic oligonucleotide
agatcatactgacctggcagtgggatggg

SEQ ID NO: 428585 - DNA, 28 bp, Artificial Sequence
  Description of Artificial Sequence: Synthetic oligonucleotide
gatcatactgacctggcagtgggatggg

SEQ ID NO: 428586 - DNA, 28 bp, Artificial Sequence
  Description of Artificial Sequence: Synthetic oligonucleotide
atcatactgacctggcagtgggatgggg

SEQ ID NO: 428587 - DNA, 27 bp, Artificial Sequence
  Description of Artificial Sequence: Synthetic oligonucleotide
tcatactgacctggcagtgggatgggg

SEQ ID NO: 428588 - DNA, 27 bp, Artificial Sequence
  Description of Artificial Sequence: Synthetic oligonucleotide
catactgacctggcagtgggatgggga

SEQ ID NO: 428589 - DNA, 27 bp, Artificial Sequence
  Description of Artificial Sequence: Synthetic oligonucleotide
atactgacctggcagtgggatggggag

SEQ ID NO: 428590 - DNA, 26 bp, Artificial Sequence
  Description of Artificial Sequence: Synthetic oligonucleotide
tactgacctggcagtgggatggggag

SEQ ID NO: 428591 - DNA, 24 bp, Artificial Sequence
  Description of Artificial Sequence: Synthetic oligonucleotide
ctggcagtgggatggggaggacca

SEQ ID NO: 428592 - DNA, 25 bp, Artificial Sequence
  Description of Artificial Sequence: Synthetic oligonucleotide
tggcagtgggatggggaggaccaga

SEQ ID NO: 428593 - DNA, 24 bp, Artificial Sequence
  Description of Artificial Sequence: Synthetic oligonucleotide
ggcagtgggatggggaggaccaga

SEQ ID NO: 428594 - DNA, 24 bp, Artificial Sequence
  Description of Artificial Sequence: Synthetic oligonucleotide
gcagtgggatggggaggaccagac

SEQ ID NO: 428595 - DNA, 24 bp, Artificial Sequence
  Description of Artificial Sequence: Synthetic oligonucleotide
cagtgggatggggaggaccagacc

SEQ ID NO: 428596 - DNA, 25 bp, Artificial Sequence
  Description of Artificial Sequence: Synthetic oligonucleotide
agtgggatggggaggaccagaccca

SEQ ID NO: 428597 - DNA, 24 bp, Artificial Sequence
  Description of Artificial Sequence: Synthetic oligonucleotide
gtgggatggggaggaccagaccca

SEQ ID NO: 428598 - DNA, 24 bp, Artificial Sequence
  Description of Artificial Sequence: Synthetic oligonucleotide
tgggatggggaggaccagacccag

SEQ ID NO: 428599 - DNA, 28 bp, Artificial Sequence
  Description of Artificial Sequence: Synthetic oligonucleotide
gccaatgtggctgaacaaaggagagccc

SEQ ID NO: 428600 - DNA, 29 bp, Artificial Sequence
  Description of Artificial Sequence: Synthetic oligonucleotide
ccaatgtggctgaacaaaggagagcccac

SEQ ID NO: 428601 - DNA, 29 bp, Artificial Sequence
  Description of Artificial Sequence: Synthetic oligonucleotide
caatgtggctgaacaaaggagagcccacc

SEQ ID NO: 428602 - DNA, 30 bp, Artificial Sequence; identical to SEQ ID NO: 78645
  Description of Artificial Sequence: Synthetic oligonucleotide

SEQ ID NO: 428603 - DNA, 29 bp, Artificial Sequence
  Description of Artificial Sequence: Synthetic oligonucleotide
atgtggctgaacaaaggagagcccacctg

SEQ ID NO: 428604 - DNA, 28 bp, Artificial Sequence
  Description of Artificial Sequence: Synthetic oligonucleotide
tgtggctgaacaaaggagagcccacctg

SEQ ID NO: 428605 - DNA, 27 bp, Artificial Sequence
  Description of Artificial Sequence: Synthetic oligonucleotide
gtggctgaacaaaggagagcccacctg

SEQ ID NO: 428606 - DNA, 27 bp, Artificial Sequence
  Description of Artificial Sequence: Synthetic oligonucleotide
tggctgaacaaaggagagcccacctgg

SEQ ID NO: 428607 - DNA, 27 bp, Artificial Sequence
  Description of Artificial Sequence: Synthetic oligonucleotide
ggctgaacaaaggagagcccacctgga

SEQ ID NO: 428608 - DNA, 27 bp, Artificial Sequence
  Description of Artificial Sequence: Synthetic oligonucleotide
gctgaacaaaggagagcccacctggag

SEQ ID NO: 428609 - DNA, 27 bp, Artificial Sequence
  Description of Artificial Sequence: Synthetic oligonucleotide
ctgaacaaaggagagcccacctggagg

SEQ ID NO: 428610 - DNA, 27 bp, Artificial Sequence
  Description of Artificial Sequence: Synthetic oligonucleotide
tgaacaaaggagagcccacctggaggg

SEQ ID NO: 428611 - DNA, 26 bp, Artificial Sequence
  Description of Artificial Sequence: Synthetic oligonucleotide
gaacaaaggagagcccacctggaggg

SEQ ID NO: 428612 - DNA, 27 bp, Artificial Sequence
  Description of Artificial Sequence: Synthetic oligonucleotide
aacaaaggagagcccacctggagggca

SEQ ID NO: 428613 - DNA, 26 bp, Artificial Sequence
  Description of Artificial Sequence: Synthetic oligonucleotide
acaaaggagagcccacctggagggca

SEQ ID NO: 428614 - DNA, 25 bp, Artificial Sequence
  Description of Artificial Sequence: Synthetic oligonucleotide
caaaggagagcccacctggagggca

SEQ ID NO: 428615 - DNA, 25 bp, Artificial Sequence
  Description of Artificial Sequence: Synthetic oligonucleotide
aaaggagagcccacctggagggcac

SEQ ID NO: 428616 - DNA, 24 bp, Artificial Sequence
  Description of Artificial Sequence: Synthetic oligonucleotide
aaggagagcccacctggagggcac

SEQ ID NO: 428617 - DNA, 23 bp, Artificial Sequence
  Description of Artificial Sequence: Synthetic oligonucleotide
aggagagcccacctggagggcac

SEQ ID NO: 428618 - DNA, 27 bp, Artificial Sequence
  Description of Artificial Sequence: Synthetic oligonucleotide
catcgccatgggctacgtggacgacat

SEQ ID NO: 428619 - DNA, 27 bp, Artificial Sequence
  Description of Artificial Sequence: Synthetic oligonucleotide
atcgccatgggctacgtggacgacatg

SEQ ID NO: 428620 - DNA, 26 bp, Artificial Sequence
  Description of Artificial Sequence: Synthetic oligonucleotide
tcgccatgggctacgtggacgacatg

SEQ ID NO: 428621 - DNA, 25 bp, Artificial Sequence
  Description of Artificial Sequence: Synthetic oligonucleotide
cgccatgggctacgtggacgacatg

SEQ ID NO: 428622 - DNA, 26 bp, Artificial Sequence
  Description of Artificial Sequence: Synthetic oligonucleotide
gccatgggctacgtggacgacatgca

SEQ ID NO: 428623 - DNA, 27 bp, Artificial Sequence
  Description of Artificial Sequence: Synthetic oligonucleotide
ccatgggctacgtggacgacatgcagt

SEQ ID NO: 428624 - DNA, 28 bp, Artificial Sequence
  Description of Artificial Sequence: Synthetic oligonucleotide
catgggctacgtggacgacatgcagttc

SEQ ID NO: 428625 - DNA, 28 bp, Artificial Sequence
  Description of Artificial Sequence: Synthetic oligonucleotide
atgggctacgtggacgacatgcagttcg

SEQ ID NO: 428626 - DNA, 27 bp, Artificial Sequence
  Description of Artificial Sequence: Synthetic oligonucleotide
tgggctacgtggacgacatgcagttcg

SEQ ID NO: 428627 - DNA, 27 bp, Artificial Sequence
  Description of Artificial Sequence: Synthetic oligonucleotide
gggctacgtggacgacatgcagttcgt

SEQ ID NO: 428628 - DNA, 27 bp, Artificial Sequence
  Description of Artificial Sequence: Synthetic oligonucleotide
ggctacgtggacgacatgcagttcgtg

SEQ ID NO: 428629 - DNA, 27 bp, Artificial Sequence
  Description of Artificial Sequence: Synthetic oligonucleotide
gctacgtggacgacatgcagttcgtgc

SEQ ID NO: 428630 - DNA, 27 bp, Artificial Sequence
  Description of Artificial Sequence: Synthetic oligonucleotide
ctacgtggacgacatgcagttcgtgcg

SEQ ID NO: 428631 - DNA, 27 bp, Artificial Sequence
  Description of Artificial Sequence: Synthetic oligonucleotide
tacgtggacgacatgcagttcgtgcgg

SEQ ID NO: 428632 - DNA, 27 bp, Artificial Sequence
  Description of Artificial Sequence: Synthetic oligonucleotide
acgtggacgacatgcagttcgtgcggt

SEQ ID NO: 428633 - DNA, 27 bp, Artificial Sequence
  Description of Artificial Sequence: Synthetic oligonucleotide
cgtggacgacatgcagttcgtgcggtt

SEQ ID NO: 428634 - DNA, 27 bp, Artificial Sequence
  Description of Artificial Sequence: Synthetic oligonucleotide
gtggacgacatgcagttcgtgcggttc

SEQ ID NO: 428635 - DNA, 27 bp, Artificial Sequence
  Description of Artificial Sequence: Synthetic oligonucleotide
tggacgacatgcagttcgtgcggttcg

SEQ ID NO: 428636 - DNA, 27 bp, Artificial Sequence
  Description of Artificial Sequence: Synthetic oligonucleotide
ggacgacatgcagttcgtgcggttcga

SEQ ID NO: 428637 - DNA, 27 bp, Artificial Sequence
  Description of Artificial Sequence: Synthetic oligonucleotide
gacgacatgcagttcgtgcggttcgac

SEQ ID NO: 428638 - DNA, 28 bp, Artificial Sequence
  Description of Artificial Sequence: Synthetic oligonucleotide
acgacatgcagttcgtgcggttcgacag

SEQ ID NO: 428639 - DNA, 27 bp, Artificial Sequence
  Description of Artificial Sequence: Synthetic oligonucleotide
cgacatgcagttcgtgcggttcgacag

SEQ ID NO: 428640 - DNA, 27 bp, Artificial Sequence
  Description of Artificial Sequence: Synthetic oligonucleotide
gacatgcagttcgtgcggttcgacagc

SEQ ID NO: 428641 - DNA, 27 bp, Artificial Sequence
  Description of Artificial Sequence: Synthetic oligonucleotide
acatgcagttcgtgcggttcgacagcg

SEQ ID NO: 428642 - DNA, 27 bp, Artificial Sequence
  Description of Artificial Sequence: Synthetic oligonucleotide
catgcagttcgtgcggttcgacagcga

SEQ ID NO: 428643 - DNA, 27 bp, Artificial Sequence
  Description of Artificial Sequence: Synthetic oligonucleotide
atgcagttcgtgcggttcgacagcgac

SEQ ID NO: 428644 - DNA, 27 bp, Artificial Sequence
  Description of Artificial Sequence: Synthetic oligonucleotide
tgcagttcgtgcggttcgacagcgact

SEQ ID NO: 428645 - DNA, 23 bp, Artificial Sequence
  Description of Artificial Sequence: Synthetic oligonucleotide
agccccgcttcatcgccatgggc

SEQ ID NO: 428646 - DNA, 22 bp, Artificial Sequence
  Description of Artificial Sequence: Synthetic oligonucleotide
gccccgcttcatcgccatgggc

SEQ ID NO: 428647 - DNA, 23 bp, Artificial Sequence
  Description of Artificial Sequence: Synthetic oligonucleotide
ccccgcttcatcgccatgggcca

SEQ ID NO: 428648 - DNA, 23 bp, Artificial Sequence
  Description of Artificial Sequence: Synthetic oligonucleotide
cccgcttcatcgccatgggccac

SEQ ID NO: 428649 - DNA, 24 bp, Artificial Sequence
  Description of Artificial Sequence: Synthetic oligonucleotide
ccgcttcatcgccatgggccacgt

SEQ ID NO: 428650 - DNA, 24 bp, Artificial Sequence
  Description of Artificial Sequence: Synthetic oligonucleotide
cgcttcatcgccatgggccacgtg

SEQ ID NO: 428651 - DNA, 25 bp, Artificial Sequence
  Description of Artificial Sequence: Synthetic oligonucleotide
gcttcatcgccatgggccacgtgga

SEQ ID NO: 428652 - DNA, 25 bp, Artificial Sequence
  Description of Artificial Sequence: Synthetic oligonucleotide
cttcatcgccatgggccacgtggac

SEQ ID NO: 428653 - DNA, 26 bp, Artificial Sequence
  Description of Artificial Sequence: Synthetic oligonucleotide
ttcatcgccatgggccacgtggacga

SEQ ID NO: 428654 - DNA, 25 bp, Artificial Sequence
  Description of Artificial Sequence: Synthetic oligonucleotide
tcatcgccatgggccacgtggacga

SEQ ID NO: 428655 - DNA, 24 bp, Artificial Sequence
  Description of Artificial Sequence: Synthetic oligonucleotide
catcgccatgggccacgtggacga

SEQ ID NO: 428656 - DNA, 25 bp, Artificial Sequence
  Description of Artificial Sequence: Synthetic oligonucleotide
atcgccatgggccacgtggacgaca

SEQ ID NO: 428657 - DNA, 24 bp, Artificial Sequence
  Description of Artificial Sequence: Synthetic oligonucleotide
tcgccatgggccacgtggacgaca

SEQ ID NO: 428658 - DNA, 23 bp, Artificial Sequence
  Description of Artificial Sequence: Synthetic oligonucleotide
cgccatgggccacgtggacgaca

SEQ ID NO: 428659 - DNA, 23 bp, Artificial Sequence
  Description of Artificial Sequence: Synthetic oligonucleotide
gccatgggccacgtggacgacac

SEQ ID NO: 428660 - DNA, 23 bp, Artificial Sequence
  Description of Artificial Sequence: Synthetic oligonucleotide
ccatgggccacgtggacgacacg

SEQ ID NO: 428661 - DNA, 24 bp, Artificial Sequence
  Description of Artificial Sequence: Synthetic oligonucleotide
catgggccacgtggacgacacgca

SEQ ID NO: 428662 - DNA, 26 bp, Artificial Sequence
  Description of Artificial Sequence: Synthetic oligonucleotide
atgggccacgtggacgacacgcagtt

SEQ ID NO: 428663 - DNA, 25 bp, Artificial Sequence
  Description of Artificial Sequence: Synthetic oligonucleotide
tgggccacgtggacgacacgcagtt

SEQ ID NO: 428664 - DNA, 24 bp, Artificial Sequence
  Description of Artificial Sequence: Synthetic oligonucleotide
gggccacgtggacgacacgcagtt

SEQ ID NO: 428665 - DNA, 24 bp, Artificial Sequence
  Description of Artificial Sequence: Synthetic oligonucleotide
ggccacgtggacgacacgcagttc

SEQ ID NO: 428666 - DNA, 25 bp, Artificial Sequence
  Description of Artificial Sequence: Synthetic oligonucleotide
gccacgtggacgacacgcagttcgt

SEQ ID NO: 428667 - DNA, 25 bp, Artificial Sequence
  Description of Artificial Sequence: Synthetic oligonucleotide
ccacgtggacgacacgcagttcgtg

SEQ ID NO: 428668 - DNA, 25 bp, Artificial Sequence
  Description of Artificial Sequence: Synthetic oligonucleotide
cacgtggacgacacgcagttcgtgc

SEQ ID NO: 428669 - DNA, 31 bp, Artificial Sequence; identical to SEQ ID NO: 78708
  Description of Artificial Sequence: Synthetic oligonucleotide

SEQ ID NO: 428670 - DNA, 32 bp, Artificial Sequence; identical to SEQ ID NO: 78709
  Description of Artificial Sequence: Synthetic oligonucleotide

SEQ ID NO: 428671 - DNA, 31 bp, Artificial Sequence; identical to SEQ ID NO: 78710
  Description of Artificial Sequence: Synthetic oligonucleotide

SEQ ID NO: 428672 - DNA, 31 bp, Artificial Sequence; identical to SEQ ID NO: 78711
  Description of Artificial Sequence: Synthetic oligonucleotide

SEQ ID NO: 428673 - DNA, 30 bp, Artificial Sequence; identical to SEQ ID NO: 78712
  Description of Artificial Sequence: Synthetic oligonucleotide

SEQ ID NO: 428674 - DNA, 29 bp, Artificial Sequence
  Description of Artificial Sequence: Synthetic oligonucleotide
ctcacaccctccagtggatgattgactgc

SEQ ID NO: 428675 - DNA, 29 bp, Artificial Sequence
  Description of Artificial Sequence: Synthetic oligonucleotide
tcacaccctccagtggatgattgactgcg

SEQ ID NO: 428676 - DNA, 28 bp, Artificial Sequence
  Description of Artificial Sequence: Synthetic oligonucleotide
cacaccctccagtggatgattgactgcg

SEQ ID NO: 428677 - DNA, 29 bp, Artificial Sequence
  Description of Artificial Sequence: Synthetic oligonucleotide
acaccctccagtggatgattgactgcgac

SEQ ID NO: 428678 - DNA, 28 bp, Artificial Sequence
  Description of Artificial Sequence: Synthetic oligonucleotide
caccctccagtggatgattgactgcgac

SEQ ID NO: 428679 - DNA, 28 bp, Artificial Sequence
  Description of Artificial Sequence: Synthetic oligonucleotide
accctccagtggatgattgactgcgacc

SEQ ID NO: 428680 - DNA, 27 bp, Artificial Sequence
  Description of Artificial Sequence: Synthetic oligonucleotide
ccctccagtggatgattgactgcgacc

SEQ ID NO: 428681 - DNA, 28 bp, Artificial Sequence
  Description of Artificial Sequence: Synthetic oligonucleotide
cctccagtggatgattgactgcgacctg

SEQ ID NO: 428682 - DNA, 28 bp, Artificial Sequence
  Description of Artificial Sequence: Synthetic oligonucleotide
ctccagtggatgattgactgcgacctgg

SEQ ID NO: 428683 - DNA, 28 bp, Artificial Sequence
  Description of Artificial Sequence: Synthetic oligonucleotide
tccagtggatgattgactgcgacctggg

SEQ ID NO: 428684 - DNA, 27 bp, Artificial Sequence
  Description of Artificial Sequence: Synthetic oligonucleotide
ccagtggatgattgactgcgacctggg

SEQ ID NO: 428685 - DNA, 27 bp, Artificial Sequence
  Description of Artificial Sequence: Synthetic oligonucleotide
cagtggatgattgactgcgacctgggg

SEQ ID NO: 428686 - DNA, 28 bp, Artificial Sequence
  Description of Artificial Sequence: Synthetic oligonucleotide
agtggatgattgactgcgacctggggtc

SEQ ID NO: 428687 - DNA, 27 bp, Artificial Sequence
  Description of Artificial Sequence: Synthetic oligonucleotide
gtggatgattgactgcgacctggggtc

SEQ ID NO: 428688 - DNA, 27 bp, Artificial Sequence
  Description of Artificial Sequence: Synthetic oligonucleotide
tggatgattgactgcgacctggggtcc

SEQ ID NO: 428689 - DNA, 26 bp, Artificial Sequence
  Description of Artificial Sequence: Synthetic oligonucleotide
ggatgattgactgcgacctggggtcc

SEQ ID NO: 428690 - DNA, 27 bp, Artificial Sequence
  Description of Artificial Sequence: Synthetic oligonucleotide
gatgattgactgcgacctggggtccga

SEQ ID NO: 428691 - DNA, 27 bp, Artificial Sequence
  Description of Artificial Sequence: Synthetic oligonucleotide
atgattgactgcgacctggggtccgac

SEQ ID NO: 428692 - DNA, 26 bp, Artificial Sequence
  Description of Artificial Sequence: Synthetic oligonucleotide
tgattgactgcgacctggggtccgac

SEQ ID NO: 428693 - DNA, 25 bp, Artificial Sequence
  Description of Artificial Sequence: Synthetic oligonucleotide
gattgactgcgacctggggtccgac

SEQ ID NO: 428694 - DNA, 25 bp, Artificial Sequence
  Description of Artificial Sequence: Synthetic oligonucleotide
attgactgcgacctggggtccgacg

SEQ ID NO: 428695 - DNA, 24 bp, Artificial Sequence
  Description of Artificial Sequence: Synthetic oligonucleotide
ttgactgcgacctggggtccgacg

SEQ ID NO: 428696 - DNA, 23 bp, Artificial Sequence
  Description of Artificial Sequence: Synthetic oligonucleotide
tgactgcgacctggggtccgacg

SEQ ID NO: 428697 - DNA, 22 bp, Artificial Sequence
  Description of Artificial Sequence: Synthetic oligonucleotide
gactgcgacctggggtccgacg

SEQ ID NO: 428698 - DNA, 23 bp, Artificial Sequence
  Description of Artificial Sequence: Synthetic oligonucleotide
actgcgacctggggtccgacgga

SEQ ID NO: 428699 - DNA, 28 bp, Artificial Sequence
  Description of Artificial Sequence: Synthetic oligonucleotide
tgcggagatcatactgacctggcagcag

SEQ ID NO: 428700 - DNA, 27 bp, Artificial Sequence
  Description of Artificial Sequence: Synthetic oligonucleotide
gcggagatcatactgacctggcagcag

SEQ ID NO: 428701 - DNA, 27 bp, Artificial Sequence
  Description of Artificial Sequence: Synthetic oligonucleotide
cggagatcatactgacctggcagcagg

SEQ ID NO: 428702 - DNA, 29 bp, Artificial Sequence
  Description of Artificial Sequence: Synthetic oligonucleotide
ggagatcatactgacctggcagcaggatg

SEQ ID NO: 428703 - DNA, 29 bp, Artificial Sequence
  Description of Artificial Sequence: Synthetic oligonucleotide
gagatcatactgacctggcagcaggatgg

SEQ ID NO: 428704 - DNA, 29 bp, Artificial Sequence
  Description of Artificial Sequence: Synthetic oligonucleotide
agatcatactgacctggcagcaggatggg

SEQ ID NO: 428705 - DNA, 28 bp, Artificial Sequence
  Description of Artificial Sequence: Synthetic oligonucleotide
gatcatactgacctggcagcaggatggg

SEQ ID NO: 428706 - DNA, 28 bp, Artificial Sequence
  Description of Artificial Sequence: Synthetic oligonucleotide
atcatactgacctggcagcaggatgggg

SEQ ID NO: 428707 - DNA, 27 bp, Artificial Sequence
  Description of Artificial Sequence: Synthetic oligonucleotide
tcatactgacctggcagcaggatgggg

SEQ ID NO: 428708 - DNA, 27 bp, Artificial Sequence
  Description of Artificial Sequence: Synthetic oligonucleotide
catactgacctggcagcaggatgggga

SEQ ID NO: 428709 - DNA, 27 bp, Artificial Sequence
  Description of Artificial Sequence: Synthetic oligonucleotide
atactgacctggcagcaggatggggag

SEQ ID NO: 428710 - DNA, 26 bp, Artificial Sequence
  Description of Artificial Sequence: Synthetic oligonucleotide
tactgacctggcagcaggatggggag

SEQ ID NO: 428711 - DNA, 25 bp, Artificial Sequence
  Description of Artificial Sequence: Synthetic oligonucleotide
tgacctggcagcaggatggggagga

SEQ ID NO: 428712 - DNA, 24 bp, Artificial Sequence
  Description of Artificial Sequence: Synthetic oligonucleotide
gacctggcagcaggatggggagga

SEQ ID NO: 428713 - DNA, 24 bp, Artificial Sequence
  Description of Artificial Sequence: Synthetic oligonucleotide
acctggcagcaggatggggaggac

SEQ ID NO: 428714 - DNA, 23 bp, Artificial Sequence
  Description of Artificial Sequence: Synthetic oligonucleotide
cctggcagcaggatggggaggac

SEQ ID NO: 428715 - DNA, 24 bp, Artificial Sequence
  Description of Artificial Sequence: Synthetic oligonucleotide
ctggcagcaggatggggaggacca

SEQ ID NO: 428716 - DNA, 25 bp, Artificial Sequence
  Description of Artificial Sequence: Synthetic oligonucleotide
tggcagcaggatggggaggaccaga

SEQ ID NO: 428717 - DNA, 24 bp, Artificial Sequence
  Description of Artificial Sequence: Synthetic oligonucleotide
ggcagcaggatggggaggaccaga

SEQ ID NO: 428718 - DNA, 24 bp, Artificial Sequence
  Description of Artificial Sequence: Synthetic oligonucleotide
gcagcaggatggggaggaccagac

SEQ ID NO: 428719 - DNA, 24 bp, Artificial Sequence
  Description of Artificial Sequence: Synthetic oligonucleotide
cagcaggatggggaggaccagacc

SEQ ID NO: 428720 - DNA, 25 bp, Artificial Sequence
  Description of Artificial Sequence: Synthetic oligonucleotide
agcaggatggggaggaccagaccca

SEQ ID NO: 428721 - DNA, 24 bp, Artificial Sequence
  Description of Artificial Sequence: Synthetic oligonucleotide
gcaggatggggaggaccagaccca

SEQ ID NO: 428722 - DNA, 24 bp, Artificial Sequence
  Description of Artificial Sequence: Synthetic oligonucleotide
caggatggggaggaccagacccag

SEQ ID NO: 428723 - DNA, 25 bp, Artificial Sequence
  Description of Artificial Sequence: Synthetic oligonucleotide
aggatggggaggaccagacccagga

SEQ ID NO: 428724 - DNA, 27 bp, Artificial Sequence
  Description of Artificial Sequence: Synthetic oligonucleotide
ccagtggatgattggctgcgacctggt

SEQ ID NO: 428725 - DNA, 27 bp, Artificial Sequence
  Description of Artificial Sequence: Synthetic oligonucleotide
cagtggatgattggctgcgacctggtg

SEQ ID NO: 428726 - DNA, 28 bp, Artificial Sequence
  Description of Artificial Sequence: Synthetic oligonucleotide
agtggatgattggctgcgacctggtgtc

SEQ ID NO: 428727 - DNA, 27 bp, Artificial Sequence
  Description of Artificial Sequence: Synthetic oligonucleotide
gtggatgattggctgcgacctggtgtc

SEQ ID NO: 428728 - DNA, 27 bp, Artificial Sequence
  Description of Artificial Sequence: Synthetic oligonucleotide
tggatgattggctgcgacctggtgtcc

SEQ ID NO: 428729 - DNA, 26 bp, Artificial Sequence
  Description of Artificial Sequence: Synthetic oligonucleotide
ggatgattggctgcgacctggtgtcc

SEQ ID NO: 428730 - DNA, 27 bp, Artificial Sequence
  Description of Artificial Sequence: Synthetic oligonucleotide
gatgattggctgcgacctggtgtccga

SEQ ID NO: 428731 - DNA, 27 bp, Artificial Sequence
  Description of Artificial Sequence: Synthetic oligonucleotide
atgattggctgcgacctggtgtccgac

SEQ ID NO: 428732 - DNA, 26 bp, Artificial Sequence
  Description of Artificial Sequence: Synthetic oligonucleotide
tgattggctgcgacctggtgtccgac

SEQ ID NO: 428733 - DNA, 25 bp, Artificial Sequence
  Description of Artificial Sequence: Synthetic oligonucleotide
gattggctgcgacctggtgtccgac

SEQ ID NO: 428734 - DNA, 25 bp, Artificial Sequence
  Description of Artificial Sequence: Synthetic oligonucleotide
attggctgcgacctggtgtccgacg

SEQ ID NO: 428735 - DNA, 24 bp, Artificial Sequence
  Description of Artificial Sequence: Synthetic oligonucleotide
ttggctgcgacctggtgtccgacg

SEQ ID NO: 428736 - DNA, 23 bp, Artificial Sequence
  Description of Artificial Sequence: Synthetic oligonucleotide
tggctgcgacctggtgtccgacg

SEQ ID NO: 428737 - DNA, 22 bp, Artificial Sequence
  Description of Artificial Sequence: Synthetic oligonucleotide
ggctgcgacctggtgtccgacg

SEQ ID NO: 428738 - DNA, 23 bp, Artificial Sequence
  Description of Artificial Sequence: Synthetic oligonucleotide
gctgcgacctggtgtccgacgga

SEQ ID NO: 428739 - DNA, 23 bp, Artificial Sequence
  Description of Artificial Sequence: Synthetic oligonucleotide
ctgcgacctggtgtccgacggac

SEQ ID NO: 428740 - DNA, 23 bp, Artificial Sequence
  Description of Artificial Sequence: Synthetic oligonucleotide
tgcgacctggtgtccgacggacg

SEQ ID NO: 428741 - DNA, 22 bp, Artificial Sequence
  Description of Artificial Sequence: Synthetic oligonucleotide
gcgacctggtgtccgacggacg

SEQ ID NO: 428742 - DNA, 22 bp, Artificial Sequence
  Description of Artificial Sequence: Synthetic oligonucleotide
cgacctggtgtccgacggacgc

SEQ ID NO: 428743 - DNA, 23 bp, Artificial Sequence
  Description of Artificial Sequence: Synthetic oligonucleotide
gacctggtgtccgacggacgcct

SEQ ID NO: 428744 - DNA, 25 bp, Artificial Sequence
  Description of Artificial Sequence: Synthetic oligonucleotide
acctggtgtccgacggacgcctcat

SEQ ID NO: 428745 - DNA, 24 bp, Artificial Sequence
  Description of Artificial Sequence: Synthetic oligonucleotide
cctggtgtccgacggacgcctcat

SEQ ID NO: 428746 - DNA, 24 bp, Artificial Sequence
  Description of Artificial Sequence: Synthetic oligonucleotide
ctggtgtccgacggacgcctcatc

SEQ ID NO: 428747 - DNA, 24 bp, Artificial Sequence
  Description of Artificial Sequence: Synthetic oligonucleotide
tggtgtccgacggacgcctcatcc

SEQ ID NO: 428748 - DNA, 23 bp, Artificial Sequence
  Description of Artificial Sequence: Synthetic oligonucleotide
ggtgtccgacggacgcctcatcc

SEQ ID NO: 428749 - DNA, 23 bp, Artificial Sequence
  Description of Artificial Sequence: Synthetic oligonucleotide
gtgtccgacggacgcctcatccg

SEQ ID NO: 428750 - DNA, 23 bp, Artificial Sequence
  Description of Artificial Sequence: Synthetic oligonucleotide
tgtccgacggacgcctcatccgc

SEQ ID NO: 428751 - DNA, 26 bp, Artificial Sequence
  Description of Artificial Sequence: Synthetic oligonucleotide
tggatgattggctgcgacctggggtg

SEQ ID NO: 428752 - DNA, 25 bp, Artificial Sequence
  Description of Artificial Sequence: Synthetic oligonucleotide
ggatgattggctgcgacctggggtg

SEQ ID NO: 428753 - DNA, 25 bp, Artificial Sequence
  Description of Artificial Sequence: Synthetic oligonucleotide
gatgattggctgcgacctggggtgc

SEQ ID NO: 428754 - DNA, 26 bp, Artificial Sequence
  Description of Artificial Sequence: Synthetic oligonucleotide
atgattggctgcgacctggggtgcga

SEQ ID NO: 428755 - DNA, 25 bp, Artificial Sequence
  Description of Artificial Sequence: Synthetic oligonucleotide
tgattggctgcgacctggggtgcga

SEQ ID NO: 428756 - DNA, 24 bp, Artificial Sequence
  Description of Artificial Sequence: Synthetic oligonucleotide
gattggctgcgacctggggtgcga

SEQ ID NO: 428757 - DNA, 24 bp, Artificial Sequence
  Description of Artificial Sequence: Synthetic oligonucleotide
attggctgcgacctggggtgcgac

SEQ ID NO: 428758 - DNA, 23 bp, Artificial Sequence
  Description of Artificial Sequence: Synthetic oligonucleotide
ttggctgcgacctggggtgcgac

SEQ ID NO: 428759 - DNA, 22 bp, Artificial Sequence
  Description of Artificial Sequence: Synthetic oligonucleotide
tggctgcgacctggggtgcgac

SEQ ID NO: 428760 - DNA, 21 bp, Artificial Sequence
  Description of Artificial Sequence: Synthetic oligonucleotide
ggctgcgacctggggtgcgac

SEQ ID NO: 428761 - DNA, 21 bp, Artificial Sequence
  Description of Artificial Sequence: Synthetic oligonucleotide
gctgcgacctggggtgcgacg

SEQ ID NO: 428762 - DNA, 22 bp, Artificial Sequence
  Description of Artificial Sequence: Synthetic oligonucleotide
ctgcgacctggggtgcgacgga

SEQ ID NO: 428763 - DNA, 22 bp, Artificial Sequence
  Description of Artificial Sequence: Synthetic oligonucleotide
tgcgacctggggtgcgacggac

SEQ ID NO: 428764 - DNA, 21 bp, Artificial Sequence
  Description of Artificial Sequence: Synthetic oligonucleotide
gcgacctggggtgcgacggac

SEQ ID NO: 428765 - DNA, 21 bp, Artificial Sequence
  Description of Artificial Sequence: Synthetic oligonucleotide
cgacctggggtgcgacggacg

SEQ ID NO: 428766 - DNA, 21 bp, Artificial Sequence
  Description of Artificial Sequence: Synthetic oligonucleotide
gacctggggtgcgacggacgc

SEQ ID NO: 428767 - DNA, 22 bp, Artificial Sequence
  Description of Artificial Sequence: Synthetic oligonucleotide
acctggggtgcgacggacgcct

SEQ ID NO: 428768 - DNA, 21 bp, Artificial Sequence
  Description of Artificial Sequence: Synthetic oligonucleotide
cctggggtgcgacggacgcct

SEQ ID NO: 428769 - DNA, 21 bp, Artificial Sequence
  Description of Artificial Sequence: Synthetic oligonucleotide
ctggggtgcgacggacgcctc

SEQ ID NO: 428770 - DNA, 22 bp, Artificial Sequence
  Description of Artificial Sequence: Synthetic oligonucleotide
tggggtgcgacggacgcctcct

SEQ ID NO: 428771 - DNA, 21 bp, Artificial Sequence
  Description of Artificial Sequence: Synthetic oligonucleotide
ggggtgcgacggacgcctcct

SEQ ID NO: 428772 - DNA, 21 bp, Artificial Sequence
  Description of Artificial Sequence: Synthetic oligonucleotide
gggtgcgacggacgcctcctc

SEQ ID NO: 428773 - DNA, 21 bp, Artificial Sequence
  Description of Artificial Sequence: Synthetic oligonucleotide
ggtgcgacggacgcctcctcc

SEQ ID NO: 428774 - DNA, 21 bp, Artificial Sequence
  Description of Artificial Sequence: Synthetic oligonucleotide
gtgcgacggacgcctcctccg

SEQ ID NO: 428775 - DNA, 21 bp, Artificial Sequence
  Description of Artificial Sequence: Synthetic oligonucleotide
tgcgacggacgcctcctccgc

SEQ ID NO: 428776 - DNA, 20 bp, Artificial Sequence
  Description of Artificial Sequence: Synthetic oligonucleotide
gcgacggacgcctcctccgc

SEQ ID NO: 428777 - DNA, 28 bp, Artificial Sequence
  Description of Artificial Sequence: Synthetic oligonucleotide
cagacacctggagaacgggaaggagatg

SEQ ID NO: 428778 - DNA, 28 bp, Artificial Sequence
  Description of Artificial Sequence: Synthetic oligonucleotide
agacacctggagaacgggaaggagatgc

SEQ ID NO: 428779 - DNA, 27 bp, Artificial Sequence
  Description of Artificial Sequence: Synthetic oligonucleotide
gacacctggagaacgggaaggagatgc

SEQ ID NO: 428780 - DNA, 28 bp, Artificial Sequence
  Description of Artificial Sequence: Synthetic oligonucleotide
acacctggagaacgggaaggagatgctg

SEQ ID NO: 428781 - DNA, 27 bp, Artificial Sequence
  Description of Artificial Sequence: Synthetic oligonucleotide
cacctggagaacgggaaggagatgctg

SEQ ID NO: 428782 - DNA, 34 bp, Artificial Sequence
  Description of Artificial Sequence: Synthetic oligonucleotide
atggaagggaagtggttgctgtgtatgttactgg

SEQ ID NO: 428783 - DNA, 33 bp, Artificial Sequence
  Description of Artificial Sequence: Synthetic oligonucleotide
atggccgtcatggcgccccgaaccctcgtcctg

SEQ ID NO: 428784 - DNA, 23 bp, Artificial Sequence
  Description of Artificial Sequence: Synthetic oligonucleotide
atggccgtcatggcgccccgaac

SEQ ID NO: 428785 - DNA, 23 bp, Artificial Sequence
  Description of Artificial Sequence: Synthetic oligonucleotide
atgcgggtcatcgcgcccccaac

SEQ ID NO: 428786 - DNA, 22 bp, Artificial Sequence
  Description of Artificial Sequence: Synthetic oligonucleotide
tggccgtcatggcgccccgaac

SEQ ID NO: 428787 - DNA, 22 bp, Artificial Sequence
  Description of Artificial Sequence: Synthetic oligonucleotide
tgcgggtcatcgcgcccccaac

SEQ ID NO: 428788 - DNA, 21 bp, Artificial Sequence
  Description of Artificial Sequence: Synthetic oligonucleotide
ggccgtcatggcgccccgaac

SEQ ID NO: 428789 - DNA, 21 bp, Artificial Sequence
  Description of Artificial Sequence: Synthetic oligonucleotide
gcgggtcatcgcgcccccaac

SEQ ID NO: 428790 - DNA, 21 bp, Artificial Sequence
  Description of Artificial Sequence: Synthetic oligonucleotide
gccgtcatggcgccccgaacc

SEQ ID NO: 428791 - DNA, 21 bp, Artificial Sequence
  Description of Artificial Sequence: Synthetic oligonucleotide
cgggtcatcgcgcccccaacc

SEQ ID NO: 428792 - DNA, 22 bp, Artificial Sequence
  Description of Artificial Sequence: Synthetic oligonucleotide
ccgtcatggcgccccgaaccct

SEQ ID NO: 428793 - DNA, 22 bp, Artificial Sequence
  Description of Artificial Sequence: Synthetic oligonucleotide
gggtcatcgcgcccccaaccct

SEQ ID NO: 428794 - DNA, 22 bp, Artificial Sequence
  Description of Artificial Sequence: Synthetic oligonucleotide
cgtcatggcgccccgaaccctc

SEQ ID NO: 428795 - DNA, 22 bp, Artificial Sequence
  Description of Artificial Sequence: Synthetic oligonucleotide
ggtcatcgcgcccccaaccctc

SEQ ID NO: 428796 - DNA, 23 bp, Artificial Sequence
  Description of Artificial Sequence: Synthetic oligonucleotide
gtcatggcgccccgaaccctcgt

SEQ ID NO: 428797 - DNA, 23 bp, Artificial Sequence
  Description of Artificial Sequence: Synthetic oligonucleotide
gtcatcgcgcccccaaccctcct

SEQ ID NO: 428798 - DNA, 23 bp, Artificial Sequence
  Description of Artificial Sequence: Synthetic oligonucleotide
tcatggcgccccgaaccctcgtc

SEQ ID NO: 428799 - DNA, 23 bp, Artificial Sequence
  Description of Artificial Sequence: Synthetic oligonucleotide
tcatcgcgcccccaaccctcctg

SEQ ID NO: 428800 - DNA, 22 bp, Artificial Sequence
  Description of Artificial Sequence: Synthetic oligonucleotide
catggcgccccgaaccctcgtc

SEQ ID NO: 428801 - DNA, 22 bp, Artificial Sequence
  Description of Artificial Sequence: Synthetic oligonucleotide
catcgcgcccccaaccctcctg

SEQ ID NO: 428802 - DNA, 23 bp, Artificial Sequence
  Description of Artificial Sequence: Synthetic oligonucleotide
atggcgccccgaaccctcgtcct

SEQ ID NO: 428803 - DNA, 23 bp, Artificial Sequence
  Description of Artificial Sequence: Synthetic oligonucleotide
atcgcgcccccaaccctcctgct

SEQ ID NO: 428804 - DNA, 22 bp, Artificial Sequence
  Description of Artificial Sequence: Synthetic oligonucleotide
tggcgccccgaaccctcgtcct

SEQ ID NO: 428805 - DNA, 22 bp, Artificial Sequence
  Description of Artificial Sequence: Synthetic oligonucleotide
tcgcgcccccaaccctcctgct

SEQ ID NO: 428806 - DNA, 21 bp, Artificial Sequence
  Description of Artificial Sequence: Synthetic oligonucleotide
ggcgccccgaaccctcgtcct

SEQ ID NO: 428807 - DNA, 21 bp, Artificial Sequence
  Description of Artificial Sequence: Synthetic oligonucleotide
cgcgcccccaaccctcctgct

SEQ ID NO: 428808 - DNA, 21 bp, Artificial Sequence
  Description of Artificial Sequence: Synthetic oligonucleotide
gcgccccgaaccctcgtcctg

SEQ ID NO: 428809 - DNA, 21 bp, Artificial Sequence
  Description of Artificial Sequence: Synthetic oligonucleotide
gcgcccccaaccctcctgctg

SEQ ID NO: 428810 - DNA, 33 bp, Artificial Sequence; identical to SEQ ID NO: 428783
  Description of Artificial Sequence: Synthetic oligonucleotide

SEQ ID NO: 428811 - DNA, 23 bp, Artificial Sequence
  Description of Artificial Sequence: Synthetic oligonucleotide
atggccgtcatggcgccccgaac

SEQ ID NO: 428812 - DNA, 22 bp, Artificial Sequence
  Description of Artificial Sequence: Synthetic oligonucleotide
tggccgtcatggcgccccgaac

SEQ ID NO: 428813 - DNA, 21 bp, Artificial Sequence
  Description of Artificial Sequence: Synthetic oligonucleotide
ggccgtcatggcgccccgaac

SEQ ID NO: 428814 - DNA, 21 bp, Artificial Sequence
  Description of Artificial Sequence: Synthetic oligonucleotide
gccgtcatggcgccccgaacc

SEQ ID NO: 428815 - DNA, 22 bp, Artificial Sequence
  Description of Artificial Sequence: Synthetic oligonucleotide
ccgtcatggcgccccgaaccct

SEQ ID NO: 428816 - DNA, 22 bp, Artificial Sequence
  Description of Artificial Sequence: Synthetic oligonucleotide
cgtcatggcgccccgaaccctc

SEQ ID NO: 428817 - DNA, 23 bp, Artificial Sequence
  Description of Artificial Sequence: Synthetic oligonucleotide
gtcatggcgccccgaaccctcgt

SEQ ID NO: 428818 - DNA, 23 bp, Artificial Sequence
  Description of Artificial Sequence: Synthetic oligonucleotide
tcatggcgccccgaaccctcgtc

SEQ ID NO: 428819 - DNA, 22 bp, Artificial Sequence
  Description of Artificial Sequence: Synthetic oligonucleotide
catggcgccccgaaccctcgtc

SEQ ID NO: 428820 - DNA, 23 bp, Artificial Sequence
  Description of Artificial Sequence: Synthetic oligonucleotide
atggcgccccgaaccctcgtcct

SEQ ID NO: 428821 - DNA, 22 bp, Artificial Sequence
  Description of Artificial Sequence: Synthetic oligonucleotide
tggcgccccgaaccctcgtcct

SEQ ID NO: 428822 - DNA, 21 bp, Artificial Sequence
  Description of Artificial Sequence: Synthetic oligonucleotide
ggcgccccgaaccctcgtcct

SEQ ID NO: 428823 - DNA, 21 bp, Artificial Sequence
  Description of Artificial Sequence: Synthetic oligonucleotide
gcgccccgaaccctcgtcctg

SEQ ID NO: 428824 - DNA, 23 bp, Artificial Sequence
  Description of Artificial Sequence: Synthetic oligonucleotide
gtcatggcgccccgaaccctcgt

SEQ ID NO: 428825 - DNA, 23 bp, Artificial Sequence
  Description of Artificial Sequence: Synthetic oligonucleotide
gtcatggcgccccgaaccctcct

SEQ ID NO: 428826 - DNA, 23 bp, Artificial Sequence
  Description of Artificial Sequence: Synthetic oligonucleotide
atggcgccccgaaccctcgtcct

SEQ ID NO: 428827 - DNA, 23 bp, Artificial Sequence
  Description of Artificial Sequence: Synthetic oligonucleotide
atggcgccccgaaccctcctcct

SEQ ID NO: 428828 - DNA, 21 bp, Artificial Sequence
  Description of Artificial Sequence: Synthetic oligonucleotide
gcgccccgaaccctcgtcctg

SEQ ID NO: 428829 - DNA, 21 bp, Artificial Sequence
  Description of Artificial Sequence: Synthetic oligonucleotide
gcgccccgaaccctcctcctg

SEQ ID NO: 428830 - DNA, 23 bp, Artificial Sequence
  Description of Artificial Sequence: Synthetic oligonucleotide
cgccccgaaccctcgtcctgcta

SEQ ID NO: 428831 - DNA, 23 bp, Artificial Sequence
  Description of Artificial Sequence: Synthetic oligonucleotide
cgccccgaaccctcctcctgcta

SEQ ID NO: 428832 - DNA, 24 bp, Artificial Sequence
  Description of Artificial Sequence: Synthetic oligonucleotide
gccccgaaccctcgtcctgctact

SEQ ID NO: 428833 - DNA, 24 bp, Artificial Sequence
  Description of Artificial Sequence: Synthetic oligonucleotide
gccccgaaccctcctcctgctact

SEQ ID NO: 428834 - DNA, 25 bp, Artificial Sequence
  Description of Artificial Sequence: Synthetic oligonucleotide
ccccgaaccctcgtcctgctactct

SEQ ID NO: 428835 - DNA, 25 bp, Artificial Sequence
  Description of Artificial Sequence: Synthetic oligonucleotide
ccccgaaccctcctcctgctactct

SEQ ID NO: 428836 - DNA, 25 bp, Artificial Sequence
  Description of Artificial Sequence: Synthetic oligonucleotide
cccgaaccctcgtcctgctactctc

SEQ ID NO: 428837 - DNA, 25 bp, Artificial Sequence
  Description of Artificial Sequence: Synthetic oligonucleotide
cccgaaccctcctcctgctactctc

SEQ ID NO: 428838 - DNA, 25 bp, Artificial Sequence
  Description of Artificial Sequence: Synthetic oligonucleotide
ccgaaccctcgtcctgctactctcg

SEQ ID NO: 428839 - DNA, 25 bp, Artificial Sequence
  Description of Artificial Sequence: Synthetic oligonucleotide
ccgaaccctcctcctgctactctcg

SEQ ID NO: 428840 - DNA, 25 bp, Artificial Sequence
  Description of Artificial Sequence: Synthetic oligonucleotide
cgaaccctcgtcctgctactctcgg

SEQ ID NO: 428841 - DNA, 25 bp, Artificial Sequence
  Description of Artificial Sequence: Synthetic oligonucleotide
cgaaccctcctcctgctactctcgg

SEQ ID NO: 428842 - DNA, 25 bp, Artificial Sequence
  Description of Artificial Sequence: Synthetic oligonucleotide
gaaccctcgtcctgctactctcggg

SEQ ID NO: 428843 - DNA, 25 bp, Artificial Sequence
  Description of Artificial Sequence: Synthetic oligonucleotide
gaaccctcctcctgctactctcggg

SEQ ID NO: 428844 - DNA, 25 bp, Artificial Sequence
  Description of Artificial Sequence: Synthetic oligonucleotide
aaccctcgtcctgctactctcgggg

SEQ ID NO: 428845 - DNA, 25 bp, Artificial Sequence
  Description of Artificial Sequence: Synthetic oligonucleotide
aaccctcctcctgctactctcgggg

SEQ ID NO: 428846 - DNA, 23 bp, Artificial Sequence
  Description of Artificial Sequence: Synthetic oligonucleotide
cctcgtcctgctactctcggggg

SEQ ID NO: 428847 - DNA, 23 bp, Artificial Sequence
  Description of Artificial Sequence: Synthetic oligonucleotide
cctcctcctgctactctcggggg

SEQ ID NO: 428848 - DNA, 24 bp, Artificial Sequence
  Description of Artificial Sequence: Synthetic oligonucleotide
ctcgtcctgctactctcgggggct

SEQ ID NO: 428849 - DNA, 23 bp, Artificial Sequence
  Description of Artificial Sequence: Synthetic oligonucleotide
ctcctcctgctactctcgggggc

SEQ ID NO: 428850 - DNA, 25 bp, Artificial Sequence
  Description of Artificial Sequence: Synthetic oligonucleotide
tcgtcctgctactctcgggggctct

SEQ ID NO: 428851 - DNA, 23 bp, Artificial Sequence
  Description of Artificial Sequence: Synthetic oligonucleotide
tcctcctgctactctcgggggcc

SEQ ID NO: 428852 - DNA, 24 bp, Artificial Sequence
  Description of Artificial Sequence: Synthetic oligonucleotide
gtcctgctactctcgggggctctg

SEQ ID NO: 428853 - DNA, 23 bp, Artificial Sequence
  Description of Artificial Sequence: Synthetic oligonucleotide
ctcctgctactctcgggggccct

SEQ ID NO: 428854 - DNA, 24 bp, Artificial Sequence
  Description of Artificial Sequence: Synthetic oligonucleotide
tcctgctactctcgggggctctgg

SEQ ID NO: 428855 - DNA, 23 bp, Artificial Sequence
  Description of Artificial Sequence: Synthetic oligonucleotide
tcctgctactctcgggggccctg

SEQ ID NO: 428856 - DNA, 23 bp, Artificial Sequence
  Description of Artificial Sequence: Synthetic oligonucleotide
ctgctactctcgggggctctggc

SEQ ID NO: 428857 - DNA, 22 bp, Artificial Sequence
  Description of Artificial Sequence: Synthetic oligonucleotide
ctgctactctcgggggccctgg

SEQ ID NO: 428858 - DNA, 23 bp, Artificial Sequence
  Description of Artificial Sequence: Synthetic oligonucleotide
tgctactctcgggggctctggcc

SEQ ID NO: 428859 - DNA, 4 bp, Artificial Sequence
  Description of Artificial Sequence: Synthetic oligonucleotide
gtac

SEQ ID NO: 428860 - DNA, 4 bp, Artificial Sequence
  Description of Artificial Sequence: Synthetic oligonucleotide
catg
